United States Patent 10,166,255 (INTRACELLULAR GENOMIC TRANSPLANT AND METHODS OF THERAPY) - sequence listing, part 2

SEQ ID NO: 144 - DNA, 71647 bp, Homo sapiens
gtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatggtgagcagctctcagcacccttggccctgactttccttccgcttctgtttgttgagcacctattgttcaaaatgcctgttatctaagaggctacagtttcctgagcgcttactatgtgccaagtacctcacacgtattacctcatttaatgcttactaaaaccctatgaggaagggaccattctcacccccattttccaaatgagacaactgagggtgagtaagatctggcttgagtcaaacagcaaataagacttggggtcagcaatgagccctcatggtctaacttcagaaccgttactctataaccccaacaaccatcctccaacacagcaaacggtattatgtccactttagctcatgagcagactgggctcagagaggttaggcaatttacccaaagctgcacagctacaagtcacagaaacagaaacccttctggctccagagcccaaaccctttctcctaagctgtactccctctctgggcttactgagactgcattttattttgaagccacattccccagccaatgcctggcaggcacggtgagtaggactggatatggaatgtgaaaacatctttacaggagaaagatttggctaaaccttaacattttcagacattttaattgcttctttggaacgcagatgtttttgggggtgctgcagccatggcccaagtagcctctgaaagatttgggtgtcaccagcaaatgagagtccctgcctgcttgctgatctcactggttgagcagcactagttccagatggttagagaactttggtgctggcttgccattcttacttatttcagtgaggccctcaaatgtgtagggagtgtgtcctaccaagtatccccctccacctgggtgtgggcagcaaacaccaaggtccccgcatatgctcgacacatcgtgtgggatacattgcctcttttgctctctccaggggcagagaaagtcacctgatttcagtggacaggaaagggacatgtttataatcagtagagggtgagggggccactctctgatctataagctcaaggtctctaaatgattaactctggtaccagcttggggaactgctgaacaccaaagacaaatgctggaccacatgactcaatggccctaaattcatcaaacagaggcacactatcggggtggtcatgacctagaagtaggtgatgtggttatcaactagcagcagacttcaaattccccactgcctcagtttcccttgttacacactagaagtttgtctctagtgctcgggcagtgggcatgatgttttatttgattgggcatacttttgcaaagattgctaagttgaacaattgctatctttgtttacattggattgatgttgaataacgggttatttaaagattttcatgagacttgaggcttcatttcagtacttccttgctcgataagtgtttgttaaatacctcctgtgtagcagacagtgtcttggcactttagtcaaaatatagataaatgacacttacttcctgaccctgaggagcttgcaatttaacaaaggacaggaaaaaaatatatatatacatacacacatatgcatttatatgtgtacatggccacatataaacatacataatatatataagtatatacaaatacatgcacacccatacatacatgcctgtgtgtatatatatatgtgtgtgttgacagatacaaaacccgagcgtgtgcatgtgatagttaacacaccatctctgtggtgttgaggacacagaggcatccagcagtgagcctgacagggaatgatggctgggtctggcagagggagaggaaatggttctgcagaccaggcagtatcccagtagcctcagagcctggccttgccctgggctgactgggtgagaaaggaggaaactctatccattgaagaaatgacatctctgtttggggaagggtggtaggcattttggatgagcctaaggcagcaggagtaggtgataaaatgaaacaaattaagacagttctagagagtgctctgaatgccaggctagggtgcgggcacatattggggagcgtagaggcgggacaagatggagtaaggagtaaggatgacattggtggtggggaactggaaatatagcccagtaggacaaatatttccatttctggaaaataactaccagagtttagacactcgccttcctgttggcactgggctctttcactttaagaaattcctatatatatgaaaatccaaacttataaaataaatctggagcctgatatttgtgtgacaaaagaattcttcccttcaggaagaaatattttgaaagctgagctcacacagtgctttcaaacataactcaatcaccctgcttgtgttaggagccccgagttgcggaaggcaggtggcctgcctggggcacactatccctcactaagcagaagtgttcatgggtcctccttttttttttctctgatggaggaagaagaaagagcacagattaatgagcaaacccagaagacagttctttctgttaacctggtgctgtctttcttattggagtttcctcctctgttttcctgcactcgttatattctccacacacacacccaggtatagattcatttttataaagaaaaaaaaaatcatcctgtcactgcctttttggaatcgacatgaagtgtgtgcccttcctttctgccaggtctaaacacctccatgccactggtgtgtttttgaattctttgttctaacaaaccagttccttatttcggagaggattataattgacagtaaatactttctttaactttctctaattacaatttgatttcaaatgtagttcatatgttttctatatagaaataacccaagcggtggggtgccaggtttttcctaagttgggaatgagcagagctattaaattaaatcacgagaaacaaggaaaaggtataattagtttctccaagaggatgccattgcacatttcctaaaagacatgaagatgtgtatgactggggatttcatgcctcataatatatatttttcttctggttttgtattctagtatggatttatcaacacctgtctgcaatctcttgtgatagagaaatttggtgaagaaacatgggaaaaattgaagtaagtatgtgaaagggaagatgaagtatctctggagcaactggtaagcctccagtgttttaaaggttacagctttttactgaccttttgattaagccagttagttgaatgaacccatcataaaagatacagctggttctcaaagagattcatttactagggagaccaattcccgtaccgtaaacatatgaattagatacaggaaacacctggtacaccttatctgtcttcgatgaaggtatcagtcttgattaccaaaatcagccttaaatgggatctcactgtaaataataccaacattattttaacttttatctcatgaatgaattctcattttctctttctaatcacagaagagagagcaactgcattatttccattgcacatcaagggagctgccaaacagaagaggggagataccttttaagtttgaccagaatcacttcttaggtgttctttggttaattcttagtttttctcctctgcctctgtccagtaaccccttaatgtcatcatttatatctccatatagtctcctgtctgactcttgcaatcttgtgctatctgtctgcttccctagaggctcccagacctaaagtgttagaagctggggatgaaagtgcctcagaaatcacttgatcctaggaagggagaggaaaacaaaaatatggaaaaatgattggcttcctcagttcatcaatgccatgcaaattaaaacaattaggcactgctttgcctattaaatctccaaaaaatttaaatgataataaccagttctggttaagatgcagcaaaatgggtaatcgctgatggcatagtaaatcagtgcagcccctttggaaagcaatctgacaacatgtaccaaaagctgtgcaaatgatcaaatcctttgaagcagtaagtccattcccgagaatctattctcttagaaatgcacacctttgtgcacacatatatgcatatatatgcaaaaagatataatgtagctttatattgataaataataaaataaaaattgtctttagtagttaaaaacaaaccaacaaacacatagaatgacaaaagaaatatgcatcatgatatagtgattgcaaagatcatgaagcaacttgcaaatttttatgacaatactgttaaaaaaaataagaaaaaaaccaaaaaagacacaagttacatatctactaggtaaattacacaaatgaaaaagggttaagagaaagaccaaaataataactaatagtgactgaattagataaaatgctggatgattttttttcctaacatctatttcccaaatttgctatgtttttattgcttttgtaatgtaaaaacaacttaaaatgcttaatgcaaactttccctcctcttcctcctacccccattttaaaaataaaataaatcgagctgagagcacagtgacttgccacaggtaggtcctgcccagacccatggccctgcacaggcctggtcactgcagcccactgctcacacacaggacaccatcaaccatcttattctcgggaaggcagcccaggggtaaatcagcatctctggggtaaattgcttacagctccacaagtttagatgggaaaaaggagctctggcctcatagaggcgaagaatattcatttccaaatattttaagtaggagcactgagtaactatgatcagggaaaccttggactcgtggacccttgagagattatttagcccagatcttcacagttgacaggtgaggaaactgaggcctagaaaggttaagtgacttggccaagactgcacagcaagggagcaacagggccaggatgcgctgtcagaaccttaaagtgctccttttcagccccctatgcggccgtgggaagagaagcatctgaagactttttcatttttttattttttgtaacagccattgcgttgtaaaggctaaactcagtaagaatagaggacaggaaagagcagtcttcttattttaagcacttactttcggccatgcctcttatataatggtcttttgaaagcccaacaagaacactgcaaggcaaggtattgccctgcttcaccaaagaggaaacagtcccggagaggatgatgctgaagactgcacagtgcataagggggctggggtggggacacaaatccaggtcggtaactgcaaagactcctttctattaggccattctacctggggaaaggaagagcaactggcaacgggaattcattttcttttttttttttcttttttggtgagacggagtctcactctgtcacccaggctggagtgcagtagcgtgatctcggctcactgcaacctccgcctcccaggttcaaatgattgttctgcctcagcctccccagcagctgggactataggcacccgccaccacgtgggaattcattttcaggggctctgggtgaaataagagaggtgtgtctttaaacatgtgtttactgagctcccatagtaggcctggtactatgaaaaacactggaggattgaagaagcaaataagccttttggcctggatggctttagaatctgtggaaacattacaggtatgcctggaacacaggaactagggtgctgaagggccatgtcagatgggaaactgggatcgtttcctctgctacaaacttgacaggggcaggtcagctccagccatgcacacctgggccttccagaggatcagctgctcctatgcagagggcaaggcgtcttaggaggaggaaggagagatggcaggctcagccaagctgttgggtggacactgcatggtggggtggggaaccaacttgggaaataggatactcatattctcagaaacacggcattgttgcaagtccttaggaagcagtcgttggattcagcgggggctctggggctacaatgctgaactcaaagcccagaagcaaggcctacagtctgtatgaccctggcatggcacttaaccactctgcgactcaggtatttcatctgaaaagaaaaataataaaagcagctaacctcatggggttattgcaagtgttaactgagattgatgatacaaaccaggcacttagaaaaaatgagtggcccaggatgagcactcaacaaatgcaagctgctgttgcataatggctgcttcagtgcttggtattggcttattttcaagatgctcgtcctcacgtgggttgggggagaggtggggggcagtggcgtgcgtcccactggactggatttgcatctgggctctgctgctcagagctgtgtgatcttgagcgggttgcttcacctctctgaagctctgtttcctcattgataaagggggaataatgtacctatcttctagggttaaggagagaattgagtggtgcaatctacacagaagtgcctagtagaaactcagtaagcatccttcctcctctctgagatataggtgctacattaagattacattatacttgacattattagaaccactttgctgctggtcagataatgatgctttccatcttgaagaagcagatattcctcaaaggctttctctttgcccagaggagaccttgcctcctaaagttagtgtgatttgctgaatggctttatctccactcctcatttcagtctgatctccctgacgcctagtgtgggccactgtctagccctgccttgaggaaccctcataaatgctagggaccaggccgtgaaggggagagatggatttttgttgattgatttttgacttacgaattttctaccatgtgatttcctggttaggacatttagcctcagctcagctgctgcttagaagaacctgtcctgcctaggagaaaggccagggctctggaaatcattgaaaatagccagaaatagccagagcacttagacatgagcagaggtaaaatgacatgttcagctctgcctacgacaggcagctgagatgtgttgtttaaggagggactctcaccctccgggtatgactgaacacagatagcatggccagctgctggaaccttcattggttgagatattcagcatatctttccaaatcaagggggaaaaaatctccagctttccatgtgtaagtggatggaagagactttttcctttttggatccttggtgcgacctctctgaaaggctggaatgtcatctctttcttcctttagaagagcagttctcatagcattcccaaacaaacaggaatccacatgacctccagggggataaaggacatttgaatgagggtacaagaatgcaagggaaccagagaaatatgtctgggaatagagaacccagcagggtacatcctgcgcttgtgtcattaggttttatctctttcatcttgaagtttcaattatctgcttaactgggtctcaggatgtttgtatacagagcactagacatctatacgattgcattggaaatgcatctttaagccaaaaataaagccaatctaagaagtccaccagctatgaaaattgcatcatattagaatttactaaaaagaaaaaagaaaaaaaaactagtgcagaaaactcagcttttaaaggagaaattaaggtgagattattggctgtgcaaaaggatttgcttaggccacatttaaataacaaattccctaatgcttttagagtagaatttcagctgagaaagaaaaaacccatcaattcctacagaaattttaagaagaaatgattaggtaaaatgaagcatgtttccagaccttatgacataaattttatcttaacatgaaataggaaacagatgtttctcctcctttgcttgcagtattttcctctcttatagtctagatttgtagatttctaattataaatcactctttttttttttttttttaagagacagggtctcactctgtcactcaggctggagtacagtggtacgatcatagctcactgcagtctcaaacccttgagcttaagtgatccttccacctcagccaccagagtagctgggactacaggaatgcaccaccatgtccagctaatttaaaaaaaaaatttttttttttagagacaaaatctctctatgttgcccagtctgtttgtgaactcctggcctcaagagatcctcctgcctcagcctcccaaagtgctgggattacaggtgtgaaccaccgtgcctggcctaaattgcttgtttataatcttttggttaaaacctttattgaaatttaacaatgagaaggaactaatggattaggaagagtaaggcctttggaatcagataaacctttacattttgcctggatcacttacttgctgtttgacttgggcaaatgtatttattcaacaagtatttagcttctagaatgtgctgaacaaagtttcaggcactgggaatagaggcaaaaggaataggcaagtgctgtgttccctgggaatgtattccaatggggaggacagtaaacaggcaaataaacaaataaatctcaggttgtgcaaagagctaaatttagagtatttagtggtgactgggcagagaagatgccagttgccctgagctggttagagaaaacctcttggcaaaggtaatgtttgaactgaaaggaaggaaggagtcagcctcaagacagagaagttatatgtgttccagagaaaatggcaagtgcaaaggtcctgaggtcagactgaactcagtgaagaaaaaaatctaacatgcttggaatatcatatgtgaggagtctgataggagatgaaggtggagagggttttagggatcaggacatataaatgtgtagaagatgagaaggagctgaacttttcttctaatgacaatgggttactgaagtttctgagctttggtgtggtcacttgtgaatggagataatcatggtgctcacctcatccacttgtgagcataggtgaggtggctaacatccccttggcactttgtttgcagaacttagtccaggattttacttccaaggatcagcaatccactatgtaagctaatgtttaaaggagttactataaagattcagaagactctaacagaactcaattgcaggaagtacagataaatctcagaggaaacagaaagtcagcaggtctgtttccaactctgcatctcccttcacgtttactctattttcctggttatctcttctctctgaaagtcttttgatttctgttccttttttttttttctgtcacccaggctggagtgcagtggcatgttcataggtcagtgcagcctcaaatcctgggctcaagtgatcctcctgcctcagcctcctgagtagctaggataagaggcacatggcactgtgcctggttatcttattttattttttggtgagacaggcttttgctttgttgcccaggctggtctcaaactcctgactttaagtgatcctcttgcctcagcctctcaaagtgctgggattacaggtatatgccaccatgattggacttaatttctgtttcttccaagcttttctatatgccctttggattcaagagatcaccatcatcagactggctcagtttctcagtgcctcaattgcagatgcctgagaaagagggtttgatggtctttggtctggagtccatatgtatcccattcagatggactttggagggtggggtctctaagaagaggtaatgggtagagccatcaggactgacgtatattctccattgtataaataaatacatgaaaacggaatgaatgattggatgattcatgtgtgtatgaatggaagatgaataaatgaatgagaggtggatggatgactaccaagcccaaccaacccatttaggagagaggtgggtgggattacatggcttctctctatgtcatgggttcttaaccaaaggttcatggataggcttgagaaggtctgagaaccctccgaagtcatctattaaaatgtcgtgtacatgtgactatatgtattttctggggagagggttcatagttttcatcagaatctctaagaactctacaatctaaaaaaaatcaaggaaccctgattatgaatccttgggatttttgttcttgctaaataggaaatgctggccgggcacagtggctcgcgcctgtaatcccagcactttgggaggccgaggcgggcagatcatgaggacaggagttcgagactggccgggccaacatagtgaaacccccgtctctactaaaaatataaaaaaattagccaggtgtggtccagcacctgtaacaccagctacttgggtggctgaggccagagaatcgcttgaacctgggaggcggaggttgcagtgagccgagatcgctccattgcactccagcctgggtgacagtgtgagactccatctcaaaaaaaaaaaaaaaaaaaaggctgttaacattgtgacatcctgagaagcattccttcgagcccagtatatcgcaaagctaattgagccagaaaaagtcagaattcattcattcccttttctgctatccctcgtccatccaattgactcaccaaatttctcaccctctcttcaagactgaaaacccctggccctccatgttatctacttttcccataaataaagtctagtttaaaagtagctgaaagcagagagtttttatttttaactttgatccaaaaatgttgcttgtctccccacttctgtccctttcctggccacaaacatttttgctggttcatctagctgcctgaaaccacagcccctcagagccagaagggcccttagaaatcaatctggtcagagcatttcacctggaggactcagcctccaaaagatcatatgagaatatctgtgggaaattctaaaaatatagtgaatattataatattaaatatacaaagcagaagtatttttttctaacaaaagctgtcaaaggtaaagcttgagaaatacttttgtttagtatgactatatggaagataaattttcttcttccttttttttttttttgagatggagtctcgctctgttgcccaggctgaaatgaagtgacgcgatcttggctcactgcaacctctgcctcccagggttcaagctattctcttgcctcagcctcctgagtagctgggattacaggcatactccaccacacctggctaattttcttacttttagtggagacaagttttcaccatgttggccaggctggtctcgaacccctgacctcaagtgatctgcccaccttggcctcccaaagtgctgggattactggcatgagccactgcgcagggcctggaagataaacttagtaggagtagaaacagatatcacgaggcctgaagcttatataatttgggaagcctcctttaaaaagaatataattaccaataaaaatttagctacaaaaataagtactcttcttagaattaaggaagaaaactttaaagctgacagataacataaacatcaaaagctggaaacatgtttttattgttagtatcataaattaactaaccctcttttataatactttcctgcatctttggctgtattttgctttttctgttcattggacaatgattttataatgtcattttctataaagaggatagaatgaatattctagcatggctggctgaaaattgtatttattgtattttgttttcattgttagcttagacaaatttctttatgcacatccataactttctcagcagtttcttgctgaagtgtgcttctttcatgttggcaagtcctgggaaaactccagcgtttgatctccctcgacctgttccacccatctcccctacttttacgcaagtcctcttggaccaggcggtccccactgggaatgcgcagcctctctttcagatgcctttttgggggttagagtagagtctggatgtgtgttgagtctaccagaagcaagtggtcctgaggactgggtggtctgcagccccacccacaggcatccaggaccactaccagggcatataaggtgacccctcaggctggggatggcttcaagctagagggggccaggtgaggctgcttcctccctgtcctggaaacctcagcttcattagcttccaaagcaaacctgaagcactcttgatttaaatcagaagttcttaaacactttggtattcagaagcctttatactctcataaattattgaagaccccacagagcttttgtttaatctatgggtatttatggtattagaaattaaaacaaattaaaaaaacatttttaaatttatctaaaataattatatgttatataattatgctgtaatacataatagtacatgttagtgtaacatttttatgataactatattattcaaataaattaatgacaagatggcattactttacagttctggaaatctcttttaatatctgacttaatggaagtaatggaagtgggattccatcttccgcaatgtatgtattctgtgatatgattttggttgaaacttgtgaagaaaatatggaaggaagaagaatttaatactcttctcagataattgtggctattcttttaaacctcacaaaagcttgacaaatcgtattttctcaaaggtcagttataatgttgaatctgtaactgtactgatgaccttcttcgtactctgttatattaaaatctcttgatctgtgttacacttggatagaaattttttcgcatcattttgtactagcttgcatgagttatttggaaactattagctcactgacttgtgctaatcttacaaatgttgacatgtttcactatacaatatcaaaattgcatttgtcaatatcatcatcaccttagcctctaaggattgggatgctaataagcttacagtataagatgcaacttttttccccaaacttgagttttgtcattggcaacacattctgccagttattttccttgaagtgacaggctaactttgttattttcttaagagaatgtgtgccaaatatccaagtctgagtaaccatagttcgtctgtcagtggttttttaagtggaaatgatgttccattaaaaaaagtggctaattcatctcataactcaatcgtgtaagtacttttcctggaagtgaccattcacactcctgcatataggagaagtactttatttgagtgcgtacttcccattctgttacacaaaatattcaaaagatgtatactcagggtcaagatttcataacattagtaatttttactacctcaaaatgaacaacctaaagtaaaactggcatttttttttactgcacatatgtgacaatgagggatatgatgactataaataatatactgaagatttaaaaaaagaatataatagttttgtgccactgtcttgattcatgctataaggcaccaaattttactcaccaatgcttatgtgccattagtgcaaatatgaatcagtacaaaaggcaaataatgtcttaatttggttttgaaaatagtttggcctcatggattcctaaaaacaccttaggtattcgcaggggttccatgggtcatactttgagaactgctggcttaaatgccttaagcatccttctaagtgaatcagaggtcaaggaaggagacatcattggtggctgagggagagaaggggaggaccagacatgacagtcttcatgacaatgacctagttgaatactatctttgtaaaaatgaagaaatggaggcacagtgagatttgctccaagtcatccagctagatggtggtagagccagggttaactcctaggtctcctcctgacacacagagtctgtgagcctctgtcaagttaggtctctcaccgaaattatcttacaattatttattgagtacttgttgtgtgccaggtacagggctaggtattgaagatattaaatcaaatgacattgtcatgatccttcaacttggtagtctaggaagcatgcagatgggcaaatcaattccactcgcagttagcacgaagacaggtgatacagagagcacggggggctcagagcagggacgcccggatctgcaagtggctgagaatgtccagaatcgggattctgacactgagttgggaaggaagaatcaagttagccagatcagggaaagtgagagcttttctagtggagcagagcctgtgggaaggcagggaagagaggagtttgagtagctggaggaatggatgtatgggataaatggctggaggtgaggagtgggtgcagaggctgggtcgtggaggctgggtatgtccacctaagaagtctagattttattaggaaagctgtggggagccagacaggctagctggaggacaggctagaaagacagtctggtgctttttctaaattccagatggttgtgacaccaggacaaatcttttgcctctctgggcctctctttccccaagtacaccttgagtcacacagtgacaggcaagtttgttatatgaattccccacctaccattaagagagctgttgaaaaaatgagttcctatggcttaaattgatcccattctcttggcctgaatcttgctacaaagtgctgttcatttttcctatgggctttatggctcaccctggactctgaataaccattacatcagtttagtaaggttgaaccacgtaaaatgtatcatttgtaacctgttgccttgccagactgaatcctaaaaagtgtttctgtgcagtggttttcaaacctggacagtcgtctgaggcgagtggttaaaaatatatggattttcagacactacctcctggggctcaggaatctgtgtatttattttgccctgtgagttgctctgctataggcagcctggccctgattttctgctcagatattttgggtatcgctagttggaactaactaaagaggaacatatattgaatgcctgctggtgccaattaaacactgattcctcagtctcctgcacatggatgcatacaagcacctatgtggctgacacttttcatgttccatgacaggtactcctctttgtgtgagctggaaacatctaactcttacttcatttcccacatttcttgcatctccaactcgatctcttcaaaatgctttccaatagtcatttttctctctttctcctctgcatatgagaggctctgtcatctcattggaagatatcaattggtttatttatttaaaaaaaattcttggtgaacatactgttttactaaagcagcttgaatgactacatatgcaagtgtgcactggctctgtgggaaatgttatatgcaggatcgtggagatcaataaacaaggctgaaaatccctgtataatcataacagtctgggcacgtctggcatcccagcaacgtgcaacatatatacaaacccaaataaatatttgacactaaaatatgatcagttcagcctacaggaaagaacaggctgccagatccagagattggtgaatgggtggtcccatcagagggccagggagcgccacagagtttgttacatttctgacggtcctggaggtcacttaaccctttctaaggtcttcagaacacattatgacaatgtgtcaagtttaaactggggtcacgtccacgtgtttctgttttgcttataggtgcagaaggagggcacatgttttcacagagacttgtgggcccctgggggcgagtaagaggcaactccaacatggtggagagtgccccacttaggcagcagtggtggtgtacagcactcctcgcccgagcaggcctacagccggtttctctgaacagctgcctccgaagatgcttagaaagcactgtataggcatgggccaaaacaggaactcttacaggtgaaggagaattcaagcagcttctagtcctagaagctagagtcctagatcctcaactgcgtgcacaagcgtttctggggctgtctgagaatccccagtggatgtgtgtgtagcagagaggttaaaaaagatggagaaacacaaatcttgcccagtacctcctctattttacggataaagaaatcaaggcccagagggggaaagtggttttccctcagagcttatttgtgtaaggtataagcttggaaccaaagtctcctaaaccccagccctggtcacctcctactcactacgcagcccctttgttctcattgtcatcacagctctcctaggatctgcatggtggttctcattttccccaagctctttcagatttgttatcctgttttatccttaccaacactcctggcagataggaagggcaggtaataataattgccacattttacagagaggaagatgaagtccagaaagatgataaagagatagttaaatttagtgatgaataaggatcctcaaacattagaaggttaggtatccagaggagggaccagcccagtctgcattttcctaaagggtagaactaaggccagtgagtaaattcccagcagcacagtacaggagtggtgtgggctttgaagttcagagcccagatccttctcttgtcaaccggtgaccatagcaagacatttaatccctctgagcatcagccttctcaacagtacgaggaatgataagtaataaattggtcatctcttgggccaaaagcacatgcttaataaataggaggtattatgagggcccagaagggggtttcatttgaacataagaaagacgtttccatcaaagagagcagttggtaagtggaatgtgctgccttgcaaaggaatgagcttgttgtcactggaagcattcaagaagaaactggaaaaccagcagtcagaaatagcgtgcagtaagaaattggacatttagaaaattggatatgtagaaaattccatacttctcgcagtgtcaagattctatggtgtgctctggataagcttgaatgctctgacccctctctgttcttcaaacatgttctctgctgcctagaagcctgttctctctgtccagaaggctcttctttgcctttccatccttcagtctcagcaaaatctccctttcttagagaagcattccctgaccaacctccttcccccatttgttaactcagttgccaactacagtttgatgactcacataagggccaagccaagggtgcaagtctcagactcccaggctaagcctcttttcagcaggcttggctatctgttgaagactaaagtccatccataactcctgcaacatagccaactacactgcaaaacagtgagaaactcaagcagctgctctaccattcagagaacaagactctatgaccattgagttccagtttactaccatatattaagttctgaacatgtgctcagtacagtgccacttgctgggggttcaaagataaaaacaggtcacaatgctcatcctcaaggagaccagctagtgggtaagaccaacaatctttatataagttgaggaaatgcatagcctatcctgggtacttgagaaggggtctccgggctcaaactgaggtccagggaaggcttcttggaggagttgacacccaaacactccagtgtctcacattccttatgatcaagaagattattgttacattatatcttgctgggtcagtggatatattcctggggcaaagctccagctgatgagcattcactgcacctcgatttatcctccagaacttctgcagaagtacaagatgccttcatgacctacacaatgtatgatgacgtcatcaccattaagctcatccaagaggcctgcaacattctgggtaagtatgaaagaacttgttttgctttcttagagctgctgtaacaaaacccagttgattctcattatttgcattggttatagtctataaagctgctgcaatcctgaattagtgaatactgcaccattgttcctaggggaaatacagggttagtttcctgaaagtctctggtcacaagatttttgccaaccaatcaatgcataactttgtttcatgtgtgcttctgtgaaaaaaatacgtatttaatatacatagttgattcattcacattgaactgctggccaactgtactgtaactcatgcctgaaggaggctaatctaacactgcctgttctctggaaggatgtgacagtcttcttgtgcttagggacactagatggcacttcagcctacatttgggggtcattctaaacagcaaaatcaccaacagaaaagcagaaaaatgtgaaaaagatgacactaaatagactgcaagaaggacacttggttatagttcaaactaaaataagaacatagagcacagccttgttctaccttggctagaagcattcatgttggccggtggaaattctgtgtctgtgaatgaccttgatagctctgtgagtattgatttcgggcctacagataaataagtagccaaatttgtgaatatgaaatcctcaaataatgaggaccgactgtatcacaacctgggtggcttaaaactacagaaattcgttctctgtggttcaggggaccagaagtccaaaatcaggttgctggcagggccgtgctctctctgaaggctctcaggaaaaattctttccctcttccaacttcgggtggccccaggctttccttggctagtggcggcataactccagcctctgcttctgtcttcacgtggctgtcttctccctgtatttgtgtctctgtgtctaaatttccatcttctcattaggacatcaagcatattggatttagggtccatcctaaatgacatcattttaacttgattacccaatttccaaacaatgtcacattcacaagttcctggtagacatgaattttaaggggcactctaacccagtacagggctcaggtatgaccctttccatttgagtggccttaggcttcttacagacaaaaatgatgagcagcaccgtctgcaccactgccatcatgtttggcttcgatgttggctttacaggtgttgcaatacctttagaatggtctgctatgattatctctgggtgtcaggaggaacaacattgagaatccgcctatgccacctacactcgtgcttacctggaaatggacgtggggtgctctgcagtgtgctgagggcccttccccgatctgctctccatcgcatattttcccatctgcctggacatgaaaatgccattgacagggtcataggagggggaccatgtgtggatggtcccactgacaatgtacgtgtcctcccaggatggtttttcctgtggatgtattagcactggattttttttatcttgttaatctgctcactccccaggcccagaggggacaaggtacaggacaaaaaaaaaaaaaaaaaaacaagaaaaaaaaaaaagaaattagctctgcctctttctagtttaatgaccgaggacaaatgacctaaatagtcacagttttctcattggttgaacaagatctaatcttcagagttatttggaggattaaatgagaaaatatatgtgaaaatatcatatgtggtatctggcatataataggctttcaaaaaacattccctccctcccttcttccctcattccctcctttccctcactccctccctccctccttcccttcctttcttctttcttccttccctcccctttgtgtttcctgggctgctgtaacaaagtaccaacaaccaggtggcttcaaacaacaaacatcaattctctcccagttctggaggccagaagtctaaagccaaggtgttggctgggttcattcccctggaagctctagggataacttgtctcttgcttctctcccaacttctggcagttgctggcaccgcttagcctgtagacacatctccccaatctctgtccccatctccacaggccttcttccctgtgtgttcacgtggccttctcatattgacagcagcctttggatttagggcccaccctaatcccttatgtcctcaccttattttaactagctacatctgctctcttttcaaataaggtcacagtctgaggttctgggtggacatgaatttgggggcacactattcaacccaatacaccctcgctttctttatccttccttctcaccagcactgagtacacaatgagccagggcaggcctgaggggagggaggggcaggcagcctccaccgtcccaggctccagggatctatgcaggaagccgaagcccccctctgtacccaggatctttgatgaggttcctctttcccttcccgttgaacttccttcacccattcctcataggcggtgctgccttgggtcactgtgagagtgtgagatggcatttaaggatgatctcactcagacgctgcatcaggcctcatgcttgtcacctggcaccgggtatagccctgttggaagtgtcaggctaggcccagtccctgggagtgtgcaagctggctcttatgcagcctgcagagggtctggcagcaggggccatggttttgagttggtttcatggtgcctctgagggcctagcaaattggcttgccattctcaggaacaatttgtgaaatgatataggtttaagccagtagcaggtatcacagtcatcagcccagcaggcgtgcctgagaacacaccagggcagctagctaatgctaagcccgcagggacaggcagcttctccagagcgcagcagtgatgtgtaaagtgcccgtgtcgtgtgaggtattgagcttatttcccttccctttggatttcagaaaaattatctgatgattaaaaagatagtgccagctttacttgcaggcaactggatctgacagatgagagggcttttcccatggctttcacatggcgctgtgactgatatctacatctcttctcatgttcctggtcatctcctggatgcagaagaccttccagggatccatatccaggagaggcccaaagtctctgccaagctgggagggggaagtcattgaggctgaggaagctggatgtgtgtggtgctcagagtcctctctggtaacaggtggtcacctgcttcccctgcccactctgggccacctgcttcccctgtccactctgggccacctgctgtctcatctcatcatgttgctctcttggagccacagagacaagcaggggccagagttgccaacgaggcctggcaggtgatggtgatcatagctaggaggaatctggtgtcccaactggttgttaaaacaacttccaaccagatgtatgttagcccctggtcacttcccacctgcatcttttgatagaaccaaggttgtgtctgaggctggaaataaggcacaaggagtgaaacagtcatttgctccttcagctcctggaactcaggcgccaagagcagcaacacctcccggatgcttcctaaagccagttcccagcctgccaccacggcagcacttagagggaggacacaggcagctggcagacagggctcacgtggcttcccaagaatcacggctgggcctctccccgaatccaccaaccagctccgctctccaaagaagcttacagagagagattctaggccaaagctggcccaggaactgggaagtgtcagtgatacctgcaaacctcacccctatcctgtccagcctgtcttggggggactcccaggcccttttgtctctccagcagctaacaccaggggaggtttctgtggggctgggttatcaaaaagcacacagcatcgagctttctgcgctcgagtctgagagcgggatgtgtcctctttacagcactgtgctgctcccaggggctgcaggcctggagacctgggttctcgactcagctctgctccccagctatggcctttttgttcaacaggtggcagcagcacagccaccccagagggtcacctgtcagcctttatgcttgacacacctgccaaagagattacctgttttgttttcttaagcatcactttaattttttttaaaagtatgcgattacgatgttaaatatgcttttgcaaaccagacagacagatcccctcttgatcctaatatgtccaccccacataggcaaagcctaggtgctgcccttgtggctgacaattctgcacatctgtgatcctagtgagggcaggaggtccacgagcaagtccagtggtttgcaattacctcctttcttctagctaagtaagaggagcatctagtaaccttccttccacaggaagaatacaaatcattaggtggaaattctgtaatgagagatgactacttttgagctgaaaatctggagttttgacagagcttaggaaataaaacggcaaaaaagcttacaatgggtagtgaaattaagcccacctttagtcttttcttgattttattccaagggatcccagcagcagaaggacgtagtggctgtatcgtgtagtcttgatttggtctgagccctctgcgaaagaacatctcgttgttattccagaatgagaatggagggtggattcttttccgtcacaccagctgtgtgaccttgggctagaatttcactgagagttgatctcctgcaaaaggaataataccttacagggttgtgggaaggaatgaattaaatcaaataacaaatgtaaggcacttagcaacatgcatggcacatactgggtgtttggtaaatgtcagccaaatgttgaatctgaaggaaggatgggggtatttctatgttttgtacctctagatactgtcccttataagaagacaggctttgctgttcacttcaaatggctgtggtaaaaaattatgttccacatgtacacagggaggggaacaacacacactggggcctgttgtgggggtcggggggaaggagagcattaggaaaattagctcacgcgtgctgggcttaatacctaggtgatgggttgatctgtgcagcaaagcaccatgacacacatttatgtatgtaacaaacctgcacatcctgcacatgtaccttggaacttaaaaataataaaataaaataaaataaattatgggccaggtgcggtggctcacgcctgtaatcccagcactttgggagactgaggtgggtggatcacttgaggtcaggagttcaaaaccagcctgggcaacatggtaaaaccccatctctactaaaaatgcaaaaaaaaaaaaaaaaaaaaaaaaaaaaaaattagccaggcgtggtggcctgcccctgtaatcccagctatttaggaggcttaggcaggagaatcacttgaacctgggaggcggaggctgcagtgagccaagatcgtgccactgcactccagcctgggcaacagagcaaggctctgtctcaaaaaaaaaaaaattatgttctgagctctctgattagtggtcagcaaactacatacagcttatgggccagatctgggcccttgcctgtttgtgtaagtcacgttttattggaacacagccgtgcccctttgtttatacatcgtccatggctgcttttgtgttacagtggcagggctgagtagctgcgcagagaccatatgacctacaaagccgaaaacatttattatttactatctgcccttcacaggaaaagttggtcatttcatgctctcaagggtggatgcagatctttttcaagattctaaaaatatcttttaacctaagaactgctctggactgaattgtgcccccatgccccaaattcatatttggaaatggggcctttgggaaataattaggttgagatgaactcatgagggtggggccctcttgataggattggagctcttataggagagataccagagcactggctctctcactccctgtcacatgggaacatggtgagagggtgaccctctataagtcaagtaatcatgttatcaccttgatctcagacttccgacctccagaactctgagaaaataaatatctgttgtttaagccaccccatctatggcattttgtcgtggtggccctagtggactaatataagaacttgaatcagcttgtatatctccagaaagaaatactctgtatatatcatatcaccccagtccatttttgtggctgtctgtgctcatgtacatcaaacggtgtggcagtacctccagcagtgagatgccatcacatacctgccccactgccgtcacattcccaacccaaccaacatgtgtagaggcagcagccagtctacagaccaatgtgtgggctggcccacatcacctttccaccgaaagccaacgtacatcactgtggtttctctctgcctagctttgaatgtcaggaatcttttcttcttgtagtttatttccataacatctattggcctatatctatctgaaagagtaaatgagtatggtgaatgcatttttcaaacaagaagttgggatgcaaaatcgagtgaacacatgtatgagatgtggaatcaggacagccccaggaagcccgtcgtgattctgtatgtctccaactcccatgagtctgagagagcaagacccatccaaaggaaaggctacaggaaggacattttactgtctaacaaaatatactggtcagttgaaaatcctccctttgacaagggaaaaagtgtgcttagtcaccactagtgagggctttgctttccatgtgggcttcagaatgcaatttccctaccttgaagcaattgctgggacttttccagaccgctctgccactgcatagctctgtgctttccaattagcataattcaggaggggaccagatggcaggttgagcattgcataaggaattgttctgtatatgaataagtgcctacttagtgtgtaagtgggttattagtgatctgaagcgacaaaattcaaaacaacacacaacagccatttggcacagctgtgtccgtctagactttgcttgcgaagacacccacagtaaaatgtgtttcaacagttagctatcagcaaatgccagcaagcctctctgcactcacatctttaaaaataagaacaacacaaaattgacaacgtcttgaaatcaggcattataacgtttgctcttcactattctcctctgaggatgggacaagtaacccaggctgtgcaaccagccacgaatggagacttgaattcaggtctgctgattccaaggctgatgcttaatcccacagactggaggggaagtcgacaatgtctagagcaagggctttggaatcagacggacctgggtgagccccctggctacaccggctcctgataatgtaacctggggtaaatgttcccctggtaatgcagcaatgatacctgtgacgttttgctcaccttatttgatttcttctgtaggacaacaacccagggggtttcatctgtcctacagaagaaatcaaataaggtgagcaaaatgcctgacaccgagtgggtacacaacaaggtacctcgccctgtccctcacccctgcttgccaccagatagacccctggccccctgctgtggccctggtagggctgactactctgttccaaggtttgacgggaaccaggaggcttcttctctaccaggcttcagcggaattgcttcatccctgcagagcaccaccttcctgagctgccttaatcgacttccagtttattttttctctgtgcctgtataaacttacgactacttctgaaacccaaccctcctaatttagagtcttcttcctccttgcaaactacagcatggacatgggcagatgtttctttccttttcttagactactctttctcctactccaaaatatttccccataaactaactcatgcctgacattagtgatatcattggagaaaaagagtatgtgagattctggctcttttcaggtatctgaagagtaatcctttggataccaacgctttgggggaaaaattacccattttcaacggaaaactttgtcaaatgtagagcatgtacttctctttcctgttgaagagcacatgttttgctgggtgactcaggaagagtgccatgaggaatagctcttgttgcctgtgacttgggtgacgggaggtgggcaggggtcttgcaagtctggccctgagtgggctgtttgtccaggaggctctgctttggtggctatggtgtccctgccagcctcactggggcttcaacaggcgctctctgtcccccagccctggacagcccaactctactctttccagtaccttgagctgaaacccagcaagaagcaaatgtttcccagtgacaaagaagacccatgcttgttaagtcagaaagtttgagttcatgcaacactccaatgtaaaagcttgttagaggtctccacacctggggaatcaagcatagaagctttgtgaccatcattttcctcctggaaaaaaagtcttgggtgggtgttgtaatcccagcactttgggaggtcaaggtgggtggatcacttgagcccaggagtttaagaccagcctggacaacatggcaaaacccccatctctacaaaaaatacaaaaattaaccaggcgtgatggcacacacctgtagtcccagctacttaggaggctgaggcaggaggatcacctgagcctggggaggttgaagctgcgtgagccgtgatagcaccactgcactccagcctgggcaacagagtgagaccctgtctcaaaaaaccgaacaaacaaacaaaaaaacaaacgaaaaaaacccaaccaaacaaaaaaaaaaacaaccaaccaaaaaaaactcaactcctttatttatttaaaaaaaatgttttaatacatacgcaaaagtagagagaattgtgtacagaagcccacataccctccacccagcttcactaattaacaatattttgccagtcttatttcatctatctgattcctccactctttttctagttttattttttctggagtgttttaaagcaattaccaggtttctcacaatttcatccataaatatttcagtattagtctctaacaagataaagacattaaaaatgtactgataatgccctgattataactaacaaaattcataacattacagaggcctgggctgcagctgtatttcagctggccatggataaacatggtctttacggtcttattatgtaagattccctatggtcttttcagagcaatcaacagaatcttttttactttgacataatttcaaacttgcaaaaggcttacaagaatagtacaaagaattcccatgtagtatttatccatattccccaaatgttgacattttaccatatagtgtctatccttctctttatatctagatttatactttttttcttgaaattgttagtatattgcaaatgtgatgccttcttgtccttaaaaattctcttaaataactacagtacaacaatcaaactcaggaaatgaacatagatatagtgctattatctaatctatagaccttattgagagttttccagttgacccagtgatgtcctttagaacaaaagaaaatcctgaatcatgtcacttatcgtgtctcttcagtattctttggcttggaacagtttctgagtctctttatgttttataaaattggtatttttggaaagttctggtcagacattttgcaaaatgtccctcaattgaggattatctgatattcctcatgatataattcaggttatgctttcctggcaggaagatcacagacgtgatctttttccttcccagtttatcatatcaggaggcatattccattcattgatctgtcctattattagtgaggctaactttgatcacttgatttacgtagaatttgccagctttctccactgtaaagttacattttccctttgtaattagtaccttgtgaggagatactttcagattatgcaaatatcttgtcatttctcaaactccctctttcatagttttagtatttatttgtgattcttgtctgaattgatacttatgatggaagtcaaatggtgattttctaagaatattattccttttgtatttattcattgagtttctgtaaggaagaatttccccctctcccccatgtatttatttacttatatcaatgtagatttgtgattcttattttttaaaaacaggctgtaatcctttccttttattatttattttgatgctcaaattgtgcaagagttagccagtgagagccaccctaaactggcccctgtgtccttttgacatgtccccatcattctttgatcacttctttaccttcttgcataacaagatgttataggctgatctcatcctttccctgccccagccctggaatctgccatttctccaaggccctgattccttttacaggagaagagcatttaaaaactaagatctagacattaggcaaccccactgctactgggatatcactgcttttaggccctcttagtggacagtgctggaaaatacatgtcatatacacacacacacacacacacacacacacacacatacacacacatacatccatctttctctctctatatatatatctatatatataatatatatctatatataatatatagatataatataatatatatagatataatctatatctatctatatatctatctatatatagatatagatatataaaatatagatatagatatataaaatatagatatagatatagatatataaaatatagatatagatatagatatataaaatatagatatatctaaaaccatgatagatttcattgtcttattatgttagattttctaatccagaggcacagggttcattctattcctcccctttccataattgtaacttcattctcagatagggaaaaacctggctcccactatccacaatatatttacttgttcagaacatagtttcagaattgctaacccacactgctgtgaaaaggaagcctactaactacagtaaaatatttgtttaaagttctttttgtttttggcctgaagacacagtagtgtaaatactatgttcaaatattactgggttaatttttttcctgggtgattatgttattcaaaactgttctgttgaaatgctgttctgtgaatttgtttctgtttgtactccatcttaggggttttctctatccttgttgatcttatattttatttattttaagcatatgaaacattaacatgactccccaaaccagaactgttcaaaaagttatgctcagaaaaatgtcattttccccaactccacaatttttctaatctttccaccccattccctaccaatgtcctgtaggtaaccaatctcaatagatccaggtttatccttctggtgtttaattttgcacaagtaggcagatagatgattatttccttgttttcccttctttcttacattaaagaatactaagcatagtataaagtctcccctgcactatcagaaaaacattttaaggcacctaagttagtttagttctttcttgcagtttctaaccatttcctgtatatcttggatcccctatgacttagcgggttcttggaatcttaaatacactgatgtgaaactgtataaaagactaaaacaggtgctgatttttttaaaaaagcggcctttattccctgctggacaagcattctcaactaagaattctagaagaagctccaaacccattacaggtggaaaacaccacactcaaacccaagatccttgtttgggaaacagttcatctctcagccagatgtcctttccttttaacagagctgggcatccacaaacaaaataaccagagcctggaacaaacagcttcatggattttttaagtttaaagatttgaaagtcaaacaggcagtcttttacccaaagctgccactcttacttgaatataactttgcttggcttacacgcagcccagtcctcctggcagaggttcttgggagaaggggggccgctgggacccctgcttttcctggcaggtaacaggatgcacctgctcagagctccagcctccaggatgcacagcacagctgttttttcttagtctgaataagctagatcagaggtaacagagggatggaagcaggagagcagaaggacaatttcccatctgtctgtttaccttttagcagtccccctcccagagactcaagcactggaaaggaacttggtagaatttgtctcagatcccctaggggttagcaggtggtccttgaatttataccagtgtatagacaagcctgcctgaggccggccaggatgcacccacaagcaaagaagccaacggaggcaattaacacaggccattaccactggcttctctaccatcccaagcttcgtctagattgagatccgactaatcaatttttggaaaatatgtataactcatcttggaaaatatgtacaactcatctctgacaaaactagaccaattcagtggggactctatcctgctcagattacagaacaattatctgccccatggtctggctgtggactatgagctgtagggaaactgctcttcagaccatcctaggaagcaagcaggggctggagagtgcccagacctccttcgtctgtcctctgtaggatttagccctggatagctcatgagacctggaatgtcccttgctgtgaattccaaatccagccagagcatcacagagtttttcaaggatgcaaccacagatactggtgatggtgagctcttcaggccttccataaacctgggcattacagacatttgccccagcccccaggacttacatgtgtcacagccccattgtaaataagagggtgtttctcacaggatctccagaccagcagcatggatggatgccctgtctcctgtgtcaatgatgccaacgcataagcagcgcttcccttggggagactccttgcttctctcattgctgcttcagaggctgggggatgtggtataaaaagtgctaaacttagagttggagcctcttcaacaaatctggcctctgcaactctatgtgactgcagtcaattcacaaagatgactcagccccaacaggctcagctgtaaaaaggacatgataataaggttagctaccttataagagctgggcaaacattgagtaacagaacagtaattaatgtgtgttgtcagaactataaaacattcttttaaaatgtttgctgtctttcccataaagtggacacttgcttactgtctattccaacagtgtagactggggagcggggaggtgggcagcagctccaactaatgccgcaaatctacctccaggtgttcatcaggcacctatgctgtgtttagcacagaaaacgtgtaggatcgggttgcttctctccagaattaccatgaattaggaagaaaaaaaaatgcaacacttaggaagagagaattcagagaaatctttatggagaatggaacaggaacactgggcctcacagggaggtcaggagagaaagggaaagacactgcaagtatttggtatcatctttttggtaaatcaggatcctgtagccttgaaggcatagttttttcattgtgtattagttatttctcagaggcatccttgtattcttgttagagactgactgttacatttaaagatgtgggaggtgttggcagtgttcgtggagggtcgcgccctccccacccagagtgaagcttgttctgggcactggcttcagcagctaagcgggtacagcatctctgcatccccttctcgactttgaggaagtatttgtcaaggagacttatgtttcacaagcacctactcagtgccaggctgcacggggctcctcccaagggcccatgacatcaatgtggttattggcattttaccgaggaggcaagtgacggcttagagagtagctcgatagtgtcacacagccaggatgtgaaccctttggaaataaatgaagaccacacaaaggacaacacacacctccaggagattttatttagggggtatgctttggtttctacaggtgtctccatggaagccatcctgaaactctttggagaatactttcaattctgaagatgtctggctatgacaggatgctacggacactgggaggaaatctcatggagtttattgaaaacctggatgccctccacagttacctggcactctcttatcaggtaaggccacttgagtctggtcttggctgcccaagaggaagcaaatgctgtggcagtcctgggccagctccccgcctcccccaacagaggcacggttgcaggagaaccctcccatctgcagaatccttggtacctggtgttggtgggctcaggagttctttttggaagagaatgaaaaagaaacacctgctggccacttttataaactggctcacaaaaaccgaagggatggccttttcagatagggtgtggtgttgatttggaattaaatcctggagactcattacaattggaacaaaggctggaaaacagtcaggtttcagtgcatttgcaaaagctctcctaaggtttcctggccaggatggagctgataaattgcatatgcagccagattcatgttattcatgtatcagaagggaagacttgacagggctaagagccagaatcggaaaccatccaactctgattaacccatgggtgactgactgaggtgttaggaaactaatttccctactgggatatatccttctggagttctttccttgggtttcttgtttgtagagatcactggaaattcaaatgcctagattctcttttattttttagacaagaaaaggtgaaagagcatttatacatatcataataatagtttattgctttagagaacatagtttaattttaaggccttatatatttcaccgagatcttccttcaccatttctatattggtgttcatatccaccctttcagggttgtcatggggacaaaatgggattgtggatgttaaaaagcctcagcaacccttacacccccccatagacgataaatgggaaaagtattattttctccatttttcatataaggaatcagaggcttggaagccttaactgacttcaattatgaatcatgaatagttgggcatgaatagctgggcctgtcctattgttatcatgtgaactactcaagggtagagggagtggaaacagccctgcttatggggtcagatgggcccatgagactgtcccactggctctaccacttaacagctgtgcgatcctggacaagttagttgccgtctctgaatctcaatttattttatttaataatatttattgggtaactaatatttattgagtgatactatgtatcaagtactttttaaggtattggacacaaacagagacaaaaaggaataaatagggaaaagataacttacctcatagcaatatgtggattacaagagataagatggaaaagtctagcattgcaatcagcccagaaaaatcagctttccataaataaataataactctattccttcccctttcttttctctctgttcaatatggccagtttaagaattaacgataatttgcatgacaacttcctttcaatttcttagctaaagcacaacaattaggatataaagaaatagagttaggcccttttaatatttttttataacacatatattttttatcctatgatctttttcctttgcttttttataatttcaattttttaaaaaagattcagagggtacatatgcaggttttttacatgggtctattgcatgatgctgaggtttggggtatgattgacgctaacacccaggtagtgagcatagtacccaatagtttttcaaccctcgaccctatcccttcctccctcctctagtagttcccggtgtctgttgttgccatctttatgtctatgtgtattcaatatttagctctcacttataagtgatgctagagaagcaatagaatagaacttatctggtggtatttgaggacattttgcacataatgaggtaaataaaatatttaaatattataatatacaagttggaagaaaatacatgcaatgatacctaacagctatatagtgctttattctgggcaaagtattatagattgtctctttaggcaaaaataacaaagtaagataatgttcactttttttgtgtctatctagtaatttggcagtgcctttaaggtatacatttctggttataactgagcctttaatcttgttatgctttggccaaacttcattgagtgctaattatgaggcaggtgttgggctaagtaatgtgtcaacattgacttaccttcttgatgccataagagtaggcagtcttatttttcctgttatacggatgagaaaactgaggtccagaaagttcaagtaactgtccccaaatcacccaggcatggtggctgagctggacccaaacccacacctgtctccaaagatcctgccctgtgctgttctcattattctttggaataataagaactttgtcaaagatcacgtggctttaggtgtacagccttatttctgggctttctattctgttctgtaatgatacctaacagctatatagtgctttattctgggcaaagtattatagattgtctctttaggcaaaagcattttttttattctgttattctttgccctaattctccacttttaaaaagccctatttgaagcaagaaataaaagtgtaattatattatttagagacttagtgacattgaccagaagaactaaaagcatgaacttttggaagtgtctctgggcagggggtaaggagtgaggggcatgaagcaggatcacgtggactttctttcaggcctctgtattctgttactttattttcactatgtaggatttggatataatttttaaattaactgttaatttcctattttatttatgctttttatatgtgctgcctcaactactctttacattttgtcaagatgtaaacacacatacatacagataaatatatgtactttctctaggtacatacttttggaattagaaaaaaatagtatttgagggctgggcgtggtggctcatgcctgtaatcttagcacttttggaagccgaggtggacaagatcatttatgcccgggagtttgagaccagcctgggcaacacagcaaagccacatttccacaaacaatacaaaaaaaaaaaagtagctgggcatggaggtggcgtgactgtaatcccagctactcagaagcctgaggtgggaagatcatttgagcctaggaggcagaggctgcagtgagccgttaccgtgccactgcattccagcctgggcaacagagcatgactctatctcaaaaaaataaaaataaataaaaaattaaaaaaaataaaaataaaaaagtatttggggaaaaaaaagaaacccattttaactaacaacatttcaccatggaagacgacaaagatcttggaaggaacccatctcctttacctattccctcacttggaccaaaagctgtgtgtccagggtgctgagttgccctctaactagctagagactcccctaggcaaaatctctatccttctttcctagtatacatctcatttactgtgaaatgataggtacttgaatgtcaacatttctggagaaaggggaggatctcttctgatgtatccttgaaggttctacttttttttttttttttgagatcgctctgtcgcccagtctggagtgcagtggcgccatctcggcttatggcaacatcggcctcctgggttcaagcgattctcctgcctcagcctcccaagtagctgggactacaggcatgtgccactatgcccggctaattttttcgtatttttagtagagacggggtttcaccgtgttagccaggatggtctctatcttctgacctcgtgatccgcccgcctcgcctcccagagtgctgggattacaggcacgagccaccacgcccggtggaaggttctactttctaaatgttcaaattgatatcacagaagacattatcctttcagaacaagacattgattaattctacttgcaaattctctgattccctgatgtgttggaaagtgaagatgcccatggtcacttggtcacaggccaagcgcggcggaaactcactaaggcttcctgttaccagcagacagctgcttttggaatatgggtagaaacagcatggcacggtgcaaaggctcatttgggaatcaaatgttgttctaccattaacctaggtttgccttccctgagcctcagtttcttcctcttcaaatggaactagtacttgccatatagagttgtttaaagtacagtaggtatagtataaaattcctgacatacaggagcagaaacagtgggagtttctatgtgattggagagagggttggcatatagctctgtatgatgtaatgggtaaatactattgtttcacaaagcgtcaaaagcataatttacacaatttgtgtccactgggaaaaatgtgtgtcttttaattaggagatgaatgcaccatcgtttcgtgtggagagaggagcagatgggaaaatgtttctccattactactcggatagaagtggtctgtgccacattgtaccaggtatggaaatggcttagctggccgcagagctatggggcttctgaagtgaggaaggtttccccatagattctccaggatggctaataactggctacgggtaagaagttaaaactcttagaatgtgtgacttcatatcatcttgaccactgctcccaatgtccttgagcttttaaaataagtttccaaaattccacaaaaatgagtaatttgtacttttctttcaacattttaaatcatacaggcttttacatagttgtgataattctgcgtatattattttgtatcagctttttatttgcatttagcattgtagaaaaagcatgtttccacataatctttaaaaccacatattaagtggccgaatgatattccatattgtaattatcttaactaatcccctattattaaattttccattgatactaatcgtttgcttttgtaaacagtgctatcatgaacatcttcatacatgctttccatttatatatttttttcttttttttttttgagatggagtctcgctctattgcccaggctgcagtacagtggcgcgatcttggctcactgcaagctctgcctcccgggttcatgccattctcctgcctcagcctcccaagtagctgggactacaggtgcccaccaccacaccttactaattttttgtatttttagtagagacagggtttcactgtgttagccaggatcgtctcgatctcctgaccttgtgatctgcctgcctcagcctcccaaagtgctgggattacaggcatgagccaccgtgcctggctctttccctatattttgtatataaccctgggatagattcccaggggaacacttttttgaacttgatccttaatgcttttacaactgaattttgcttacattatctctaggtttatttgtttgtttaatgagttaaatgcctacctgaaataacaaacaaatgaatagatgccaaactagaaattaaagtggcatggatatatttggtatccaaacatgtataacttcagtctctgcatatttttatttaattggctgtcactgatgtctgatttgaagcagggcctgggcttggtgaacttcagaatattcatcagaagttttgccatttgattattttatgatttttgctgataaagttgccttcggccatccctcgacaataggtgtccttctgctgcaggtatcattgaggctgtggccaaagacttctttgatattgatgtaatcatggacattcttgacatgaatgaagaagtggagaggacagggaagaaggagcatgttgtgtttctgattgtacagaaggctcacaggaagatgagaaagacaaagccaaaaaggttacaagacagtcagggcatggagagagaccaagaggtactgggtttgctgtgcctttagaaagaacagttgcacttaagtagagctacgagtcttggaaaaatctatgcaaacaacagaatcaactggacctttttgtttttgtttttgttttttacgttttcctttaagttctgggttacatgttttgaatgtgtaggtgtgttacataggtatgcatgtgtcatggtggtttgctgtacctatcaactaggttttaagccccacatgcattaggtatttgtcctaatgctctccctctccttgccccctgccccctgacaggccccggcgtgtgattctcctctccctgtgtccatgtgttctcactgttcacctcccacttacgagtgtctgcggctataccaccctgaacgtgactgatctcggaagttaagcagggttggtcctggttagtgcttggatgggagaccaactggaccttctaatagtggaattaaggcagagtttctcagttttggcactgctgacattttgaaccagataattctttggtgttgatggggtgtctttcacgtcatagtgtgcttagcagcagccctggtcttttcctactagtagaacctcatcccctcatttgtggccaaacaaaaaagaaagaaaaagaaatgtctcctggcattgccaagtgtctgcgtagtgggggtaatggataaaatcattcccagttgagaattgctgggttaaggttaagtggatatatactgggaagcattctgggatgcacctgagcctggacaatttttcacctataacaataaccatatgaaggatttgaaatttgaatttgatggcttttttttttcaatcctcctcaaataaattgatctttccagtcttcagtgcccacttctgcagctggaaccagtcataggtcctgagtcaactcaagactctgtacttggccaccccagttgcaactgatagggtgatcattacctgcttaagttaccatgtatgttagctgaacagctctccatgcacatagcttgtgaaaatacccagattaggattagtctctgattccttagagtattttcaaagtccatctcagagtctgttcactgcagaatcttcaaccacaggaagaaatgttcgtgcatgattttcttgccagatatcatcctagttccctcttgagattttctaaaaagttattgctttctttgatagagaaacagcatgaggactaatttgattaaaaaataccgggaacgctaaagtcttggtagaagtgatcttgtaagccctcatgctgttcctctggccatggatacagttccttatttaaaggtggaccccatcacagcaaatggggtttgtgcttctccagtcatgtgaccaggtacctgtctccctgccacctgcaggccctccaggcagctttcctcaagatgaaggagaaatatttgaatgtctctgcttgtcctgtgaaaaaatcccactgggatgttgtgagaagcatagtcatgtttggaaaaggtaagtgagtgattctcccaagctcagctctgagatcagaaagattgcttgattctcaggagtagtggccagtgtacactgacagggccaagccctctgtgattgtgttggcactagtttctgcaaagcttggatttggtgaccatggtttttaactttaaaatgtcaggctctaattgtccttccattgcctctcattatttgtgccgggtgacatggagacatcatctcccctgtcctaagaaaaagtttttggagacacaattggaatcactcccaacaggtgatgggtggagagaaggaagatgagcactgatgtgccatcaggaacaatgaattttccacagctcgtcttctgcagtcaggccttctccatttggacacatttctggactggagatctgtggataacaaccctagtcgcccaagcaaaggacactagatcaagagccaagaaagcaagtttctggctctgtgcctaaggagctgtgtgaccctggacaagagtctccatcttctcatttgcaaaatgcaggcattaggcttgctaaggtacccctgtgggcactgagcccgtctaacgattagcacctaacgcctgagtctgaataagggctctgatccattgggagaagggagttagggtgctctgcgtcacgactcaatgggccaggtgacacgcatctgggagaaggtctgcagggctcaaagggctgcattttgcgtccttcaagccatggcaagtgagtcaaacacgcaattgacatcctttgtctaggagattttcatatcaaaaaggctccatttcgaatctctaccccctgccaaataggactgttggttaaattttcacgtgccacccaaaactgtcagtctaaaaagctccatggcaaatgtccctgatgctgggcccggagcacacgctctgctctgctagctcattgtctggctgtcaccatttcaatgccgactctgtgttcatggcgagacatactcaattggcccagaaactcttcagcggcaggcagaaacttggcagggggcaggagggcttctcaacctggtagcaagttttctgtttgttttaatttggaagaagaattgctgtggccatctggagatgctgagggagtccatgcaaaagaagtgagattgcactttgcttgtgaaacacttaagatactatccctatcccgagctctgctctgtgcaagggtggaggcgggagctgcttctcatcagcacttcctttttctatgtccagggcatctcatgaacacctttgagccaatttatcctgagagactctggattgaagagaagacattctgcaacgcttttcctttccacattgtattcgatgaatcagtaagagactcttccctctgtagcttagaattggggctaagccagggaagtgagcatgatttacagtccttcatgaacagtggagattttcaagtccctgagaaattcccagggcttgggagactaggctttatcctggcaggaccattgatttgcttttcatattgtggtatcctccagaatccattatgcaggatcttcttgatagggtagaaagggaggtttgaactagtgaatgcatgggaaagtttaccattagaaaaaaggggaaaaggaagtgacactaaaattcactacataaagagacagcagaacacagtcagtagcaacaatagggtggaattctacccatgaactcttcccatccttgtgaccaccatgtatgtctccatcccacccagcttcacattctgcctcttgaacatggggaaggggtcatgccaactcaagccactgctctgtaagagttgtgagcataactatttaagtttgattgttaatccatttctatggataaaatatatgtcaactgaattgattaggaactcatttaaaggacacctattttacttcttccttctgtgtgttcactggagatagcagtgaaaggtattcccccacccccttgatggatttcttcacccaggcctgggtgatagatccaatgctatagaatttgctagtttcttcattagtaaatgatagagagagtgagagagagagttgtctcagagagcaaggaggaactattagcccaacagagagctgtaacctcatttctctttagtcggaaataagcctctgagcactctcgtattattcttttctctttcagacattagcacagatttgattgtttcaaaaaaatttattacttccatgatgttgattccattactgaccccctttcccgatagtgagccacagaacatggctagaatgttatttccaaggggaagtttatgggaagggaggttgctttctattcctcagcttatatctgtcctctgtggatagctacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggtaatcactcactcctttcctgttgctccccacctgtttgagagattgatccgaaagggaagaggcagttttccaatttcctaaaaagtagggtaggggctacgttgagaacacgttttcttttttctgacgtttccacttgacttgatctgtaaagaatatattttatttcctcaaccatctctggcttagacgtaaactatgtatgtaatatagttacatacataattatacaagtatatacattatgtaattataaaattctgatatgttaccaaaattttcagaatgcatgaggtgctattggtattaaattaatgtctgtattttatgtagcaacatgatcatctaactcactattagtagggcccacattttgtttttaattgtagtaaaatttacataacaaaatttaccattttaataatttttaaatgtacagttcattggtattaagcacattcacacgttgtatgttgtaccttcactaccatccatttccagaacttttttatattgtgcaaaactgaaactctgcctattaaacaataattcatttgtccttcctcaattccccagtaaccagcattctaccttctgttcctatgaatttgacaagtctagatacctcatataagtggaataatacagtacctgtccttttgtgactggcctatttcgattagcataatgtctttaaagttcatccatattgtagcatgtgtcagaatttcctgcctttttaaggctgaataatattccactgtatgaatatacaacattttctgtatccattcacccatcaatggacagttggatttcttccaccactttgctattgtgaataatactgctacaaatgtgggtgtacaaatctctttgagtccctgccatcatttatttggaatatatatccagaagtggcattgctggattatatggtaattctatttttaatttattaaaattaggaacttccatactgattttcatagtggctgctctatgttacattcccatcatggacatcaatggacaagtgttccaatttctccaccatcctcatgaacacttattatctgctttttaaaaaatagtagccatcttaatgggtgtgaagtggtatctcattgtggttttgatttgtatttctctaatgattagtgatattgagcatcttttcatgtggttaatggccatttctacttattcttcagaaaaatgtctattcaagtcttctgtccatttttaattgagttgtttgcttttgcagttgagttgtaggaatttcttgtacattctgaatattaacctcttatcagatatataatctgcaaatatattctgtatgttaccttttcactgttggttgtgtcctttcatgcacaaaagattttaattttgatgaaatccaatttatctattttcttttttgttgccagtgattttggtgccatatccaagaaattgttgccaaatctgatgttgtgaaacttttcttctatgttttcttttaagagtttatgttttagctcttacatttaggtctttgattccttttgagcaaatttttgcatatgccttgaaagggcacacattctgagctatctttctattagagggatgtttagttattccagggataagcacaggcagaactcgggggatgtccaaggggagaatgacatgttctgggaacccgagtgaggtgtagagtggagtgatgggagaggaggctggcaagatgaggacttgaactctatcatgcagctggaaacatgctgaagtgtctgccatgatcagatttgatgtttagaatgatcactctggaggtgtgtgaaggatgggtcacagtgtagagaaaatggatcctgggaggccagacagaggctgcttctggagtccaggaaagaaactctaaagtgctaaactctggcagtggcactggagtggcaattggaggatagactcacaagataattaaggcaggacttggtgactggatgtggggggtggaagagaatcgttaggataattattagcttccttgattgggtaactgggtgatgaaggtgcaattaactgaaaaaaagacataatgtaatgtccttgaggcagggatttttgccagtttgagtcactgctgtatcctcaatgcttaaaacagtgtgcctagctcatcgcagggactaactacatatgtaatgaaagaactaatagaaagagaagatttgtggaggggatcgaagttgagttcagtgcagatatccatgaacagatacctaatagggagaacagaagaaaaaaaaacactgttcctggaggtattaattgtcagaatcatcctagagtgtattttggcaatacgtatcaaaagccttaaaaatgaggatattctttgtctaagtaacccgtgtctaagaatatatctttttaacaaactaactagccatgattatacacaaagactgcctcaagcttattcatcacaatgttgtttatacaatgataagctagataaaatataatcaatactagcttattatttaataaaagacagtatgagcaaggtaaccagcaaaaattaagatgaatatctatatttaatactatgaaagaatatgttatatattttaagtgaaaaattcagattatgaaaagaagatgccatgtaatccctgtttttttgtaaaacaaagatatactacaaaatattaacagtaattatccatgtggtatgattatgggtgatttttactattttctttcactttttttgttttctgcaatgaatgtgtactgcttttacaataacataacaaacatatctatttttaaagaaatacacatattgagttcaggaagcaaggtttctctggaaattcagatgcagtcagcgtggtgtaggatgcagttgtgtgatgctaaatgagaataccaagacaaaaccctcaggaacactaacatttaaggaatgagattaaaataatgtaagtaaaaattcaaagaattaggggacatctcagagagaaagcagtgtcagagaagtcctaggaagtgagatttcgggaagaagggtctggttaacatcatcaaacagcagaaaggctgagtaaagaaaaggccaaggaacttgtgttggcatcggtagcatggaggccattgatagatgggagccacttcaatgtaggcaatggacacagctgctagggacagaggggagataagtaaggtctcacagaccttgggtaaaagagaaagagcgtgactgtgcagtaactagaagcacacagtgtgggagatgattggttgtccagcgagctcgtctcagtccctactggtgacatactctactgttgcatttctctccatgatggcaaggccagatgatctggatggagtccatgtggtgcatggtgtacctgtgctctccgaagctccgcagcctgcaagagctggaagaactcaatatgcatctttctgacatcgcccccaacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggtaaggcaccctctcctccacagcgtcctctgagcagagcgtggtatgtcttagtggtcagggccacaggctttgaagccagacagaagtggttttgaattctggctctgtcacttgtaagtggcatgatcttggggtaattactccacctgcatattctcagctttgttctctctacattaataataataataataaaaataatacaggagtgaaacatgaattatataaaaatggttgtcaactacacacacattaaattctctaagaatttaaggatatgtcctgagactggcctcattactcagtgacaatgagtagggttcttaactttaactagaaataatacactcgcacactagttaaatcatagggttcctctgaggaccattctgggacagtatactatttatggaggcagggatgctgtgtttaccctgaactcactttccgtttgtcatgggattgtgttcattcaccagacacgcctggtgaacttactctgtgccagggtgctgttccagatctggggacacagaggagtttacagcctcatgagtttgatagatatatgcagaataaattaatgggggtggaaatgaccaaaggaaaagaaactaatttgcattaaggagcaattattgtgccaggatccatgttagacattttacatgtgcagtttcattaaattttctcaacatttctatgaaggaggtgttgtccataccatattgctgagcaaattgacattcagcgcagctgataaatgaaagaggtggaaactaactgcgttaaggccatctaactccaaaatccatactctttccatcacacaaggtgctatggcaacatggggacagggaaattaataataaatagatgtcaggagataagagataggggggtgggttggagttgtggaggtacctctcaaaagtgtgtgacacttgagttgggccttgaggctgaatttcagcaagcaaagaggaaaaaggcatttttggagaatgggctagtaagagtcaaagttaaggcaatgtgcaaacgaataccatggggcatgttcccagagcgtggggtatgtggaaaagtggggtctggtgacgctgagtgggtagggtggggttcaggtgatgcagtgatgaatttggactattagggaaaaggaaattgtcttttgtaggcagtgagaattcattgaagtttcttctcttattatggaagtgacaggatgagttttataaatccgattttggctgcagtgtaatgaatgcatgagggggtgctgaaagaccataagggcgcagctgattgatggtagaggcctgaattagggcagcctgaggaagaatcagcaggatttcctcactgaccagatggggaaggtaagacagcggaggcaggcatgggtctgaggcttctcgcatggaaaaatgggatgctttatcctaagacagggccagaaagaagagcagggttgggggagaatgataaggtccattttagaaccattgagctggagatgtctgtgggatactccacacagcatgatcagtggtaggaatcttagtgagagctcataggaacattgtggcatggagctatacatctgggagttattgcaatgtgggcggggttaatcatagactctgaatggtggataagatcacctagaggacaggaagtgagaagagagtggagtattactctttagggaacatctagtgcttaagaaggttgagaagccaaggaaagatataaaacaaggagatcagaaaggtaggaggaatatgaagagaggatgataggccagaagccaaggagaagggaaagttccacaaaggggaaattaccatcagaggcttaactaacaaagaaggcacccggctgcattcaaggagtcattgattcactcactcaatatttattgagcatttactatgtgccaggccctgctttaggtgcttgggatatggcagagatctaaactgacagtctcccgtctcatggagctttgtattccaatggggtggtagacaataaccaaataaaccattccatacaaaatatcaggccgggcatggtggcttacgcctgtaataccagcactttgggaggctgggtgggcagattgcctctgctcaggagttcgagaccagcctggacaacacggtgaaaccctgtctctactaaaactacaaaaaattagccaggcatggcggcgtgtgcctgtagtcccagctactcgggaggctgaggcaggagaaatgcttgaaccaaagaggtggaggttgcagtgagccgagatcatgccactgcactctagcctgggtgacagagtgagactctatctcaaaaaaaaaaaaaaaaaaaaatatatatatatatatgtatatacatataatgtcaaatgtatggagtgggtggaaggcaatcaagctaaaaggatagccagtctaggggctattttatacagggtggtcaggagagttctcactgagttggttacatttgaaatgtgagtaacaggccctgtagatatttgagaaaagtgtcaggcagaggaaacacctctttttttaagtgtagaagcctgaaggcaggaggcacttggcatgctggagaaaccccatgaggccagtgtggccagagtggagggagccggagggacatggggtcagagaggtggcagggacagaggtggggggtcccctctgtaagccatggtcaggactttgggttgcattctaagtgtgatggaagtcatgaaagatttgagattgaagaatgggagatctgacttaaacagggcatctggctgctatgtggaagttagcatgaatgggggccaaggtggaatcaggggcatgatttaggagcaagtgttcaggacaaggtaggtttcctgccattcaaagacagggacccatcacttcacagtgaccagtctctgtcagccctgtccccaggtctcctgtagctcaggctctgcttggcccacttgctaggggccctttctgtcctcccacagcactggtcacattttactggaaggatttgttcacttttatgtctccttcattagactgggggctccttgggggcgagggcctggtctgcttgccccctgtgatatgattctcctactacgactagcttgcagcgggcactcagtaaacgtgtgctgggtgatgctgaatggggaatggcatccagctacttttcccacaaggcacagggcaggtttgattctcacagggcctcttaatccagaattcatggacttattagtcgatctccttgtttctcactgatacctggtttctgttgtaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtaagtgtctgtgcagtgtggggtgtttcacggtgtgctcacgcagggcgagtgcttgattctaagtctccctttgcctctgtctgcactggtctggggtttggtgtggatgagtgtggggtcagaataaaagctgaaagggaattggaagtattttaggaattctagtttttagaaattctttttacaatgctcagtgctaagatggcactctggtgcccttgaggggcacctagatgtcaggtgttttcatagagtgtagttctcctactcctaaattcagcagaaaatcgaatctaaacaatgtgttatctcatatatagcatcacatgactaccccaggagcttcgtcttttctgggatttgtttccaccaaaagcagaaaggccttttggctctctcatggttgtttcctgagtccttttctttctcacctcctccctcatgctcctcatacccttagcaaagaatcaattaccagctttagtatagtccctttgtctatatatggaaaatgaaaaaaagtgtagtgacatgtttagtgcatgaaggaatccctctgaatacctatttttttttccctgacaggtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccaggtagagagcaactgagtacttggcttaatgccaaacatctcacacacaaaagtagaattctgcttatgtgcttaggtgattactgggtaagttgctgtcattaaaatgggtaatgtatcctagcccttttcttctcttgcatatgtccctaatagagatattcctaaggctcctatagtctcaacttttctcaaatttcagaggaggctgcggtgctcaaggttttcctacgattgactgcaagcttcctttgttggtaattcaggacagtgctgagcagttcttcctatttacctagcagggctcaatccatcttaaacaccagctcatttataattcctgcttttatgttcaagcatttcaacaagtggttcaggtttaatgagcagccaacttttcctgcttaggaaattgtgtctccaacatgccatctgacaggttcagaactcaggctgaggtgtgaggctgcctgcagtcagcaggccaggcaccgtgatgccgtaagatattcagaatggctttccttccaccaagtggccactagcgagacatctgctcgcctttctcacagaaaagtacgcttccaagtctggaagtttgttcacactctaaaagttgaacagttttggaggtgaaaaatgaatgtcctcctccgctggctcagcagatcctaatgctcctgggatggctgagagtggcgtctctctgcctttgatttctaggtccttcctctgctaatatcagtcagaaatttaaaataaactagtcaattcaaaataaacaaagccaattataagatggaatatgatttttccacattataactttttacaggagattctgaaaatctgctgcactcactctgaccatggtgagttagaagctgagaaacagtgcagatcatggctacagcatccactgtagtcttctaagtaaaagctggccttagatagtcacaagaacaagatagctgccataatgactcattgtaaacacagtgtgcatcagtggaataaaaatccaatgtaataaataaaaaatcaggatgagaggcaatgagggaagagatataagaaggttagataagagataaatgtttcagttaaaggatgcttgtgtaagtcactggtgaaaaataaaaataaaaatggaaagcatagtgtgcgtgtgtgtgtgtgtgcgtgtgtgtgtgtgtgcatgtgtgtatgaaaggggcatagcgccagagatgaaaataatgctacaccaataagaatgaaattagacaatgaattgttggaaactctcaaggtggatttaccaagaaaaaaataggaaaggatgttagcaattccaaggtaagactatggacataattaggagcatcattaaatatccaccagaaacagcatatcatatgggtttattcaaggatgtaggggagagaactggaaacactttctctcttaacagaattgtgcaattattttgcactgagatattctattattttattcatatagctttaatatacatttactgagatccatccatgtatgagacagtattactaggtgctttgaagggttcagagaatcctgttttcctagagaaattataattttatttcaagcagaagaaaatctagcaagtaaaaacaacaagcaatctgattaggatgtagaaagctgtaagagactgttgttcccatgctagcagttttttttcccccaccagaaagcaaaggaatcaaaataaactaaattccaggaagtgacaaacctttcaaagagaagacacccataattgcattcaatcctggcagggcagcagaagaagtaatccaccagaggtgagggtagggataatcccgtctaaattttagtggacttttaatggtcacagggctgaaacaacaggttagaatgccaaagagtcccagccacagagtctgtacccatctaccaactcttcctcataggccaagtgcaggggattagtcagccaaaaactaggacaggagaggagagctgagagaactcccgagtccctgaggtgtttggggcctttcccaaatgcaaagcagtggcccattaaaggctaatgttagagtaagagaactgagagaaatccaactgaagtactcttcgtcttcaccaagtacactacgatgaccttttgaagtatgagggcaaggaggaatggcagagaaaattttcccaaggtgcagagagccagggtgggactgaagagcaaagagacttctgaaaatctcactgttgggctgtaatgcaggaggagatctcctacaactccaaaagctgtggattggctgtacagcattcaaggtcctcagagtcttgctggtgctcagattctaagctctgctgtactgaaagttctgattcagccttcataatatttgaaaccagtggtgcatggaatctaccaatatttctggaaaagccctgacccaactcaaatatggattagatttacttactgcccattccagcagcctaattctgtagggatgtaacattttctggtggataaatattatctacttcagtctctactgtattttcacacacaatatgggtcattcaattagataatgaaaaatatgagatgcaagaagcaacaagaaaatagtaatatagtggatagccaatagagaaaatagtcaatagaagcaggtccagaaatagcctagatgttggatctttaaaattagtgtgataaatattttaaagggtctataagaaaaggggcaaaacaagtgtgaagatatgggaaatacgtacatactgtctatatttacatctatatctatatctaacagaaaactatgatatcagaaatcagaaataaagaattaattttatgggctcaacgaagactagacacaatagagaaaaaaatcagggaatttgaagacagagaaatagaaatcacccaaactgaaatgcaaagaagaaaacagggttaaaaaggggaacaagacactctatatctgtaggacaatatcaaatggactcccatatatgtaactgaaatgctagaatgagaacagagtgagaatgggtaagaagaaatatttgaagagataatagttgagaatttttcaacatgaaggatatcaatgcacacatccagagctcagcaaacccaagcagaataaatacaaagacaaccacttctagttaaagcataccaaaaactctacccagtgaactaaggcaagaagaagaaatataagacattaagtttggaaatgaatgaagaaataaaattatcattattcacagaacaaataatggtgcacctagaaactcttatacaaactacaggaaactacaagatctaataaatgagtttagcaaggtcatagcataaatacaggaaaattaattaaatttttatatgttaaggacaaaaaattgaaaatgaaataaaaagaaaataaacttaattaaatttctaggagtaaatctaacaaaagatacatatgacctctatgcttaaaactataaggtattgcttagggaaattaaagaggacctaattaaatagagagatataccgtattctttggaaaactcaatatatttaagctgtccattttccccaaattgatgtatagattccgtagaataccaatcaaaatccctgcaagcttcttagaaaatattcacaagctgattttaaaatttatatggaaatgtaaagaatctagactaacccgaacactcttagaaaataacaaaattggaggatgtacacaactaattttaagacttattctaaagcaacagtaaaaaaaaaacagagtgagattgggagaagaatagacaaagagaccactggagcagcacagagtgtccagacatagactccatgtttagtccattgatttttgaccaaggcaccaaataattgagtggggaaggcaacctctttttaaaaaatgattctgttaccattgaatatcatgtggaaagaaaaaatgtacctcagttctaccttaccccatatacaaaaaaaatcatttgatatatatcacaaatcgaaacataaaatctagaatcacaaagcttcttgatggaaataaagaatagcatcatgactttggggaaaacaatgatttttttttttttagataggacacaaaaaacactgaccatgaagggaaaaaaatgataaacttcattgttacaggctgaattgtgtcttgcccaaaattcttattttgaaactctagtactcactacctcagaacatgactgtctttggagctagaggctttactgagtaaaatgaaaccttaagagtaagccctcatccaacgtgcctgatgtccttataaaaatatgaaatttggacgtaaagagacactaagaatgcatgtgcacagaggaaggaccacgtgaggacacagcaaaaaggtggacatctacaagccaagcagagaggcctcaggagaaaccaaccctgcccacagcttgatcttggccttccaggctccagaattgtgagaaataatttccattgtttaagctacacagcctgtggtattttgctatggcagcctaagcagatgaatacattcatcaaaattaaaacattctgcttattaaagaaaataaatacacaaacccacagactgataaaaatatttgtaatacatacatattacatatccaaatatgtgtacaattcatacacattaacaataaaagacaaacagctcaatttttaaaacaggcaaaaaattgaacagacttttttacaaaagaaaatatatgaatggccaatgtgtgtgtgacagtgtgcctaacatcattagtcaccaatttaacgcaaattaaaaccacagtgagatatcatttcacacccacgagaagaccaaatgatggtgaaaatgggaacaactgaaagtgtcacgtcgctgatagaaatgtaaaacagtaaaacaactttggagaattgctgggtagttttttggcttgttttgttaaaaaataaaattaaatctgtatctaccttgggactcagaaattccacttctaggtatttacttaagagaaaggaaaacatgtctacaaaaatatctgtacaggaatgtttatagcagccttaattttaatagattcaaactgaaaaataatctaaatgttcatgaaaaggagactggataatgaatgtggtgtattctaacaatagaatgctattcagtgataaaaataactactgatatgtaagacaatatagatgaatctcaaaaacattatgttgagtaaatgaaaccagatataaaacagtatatactataagattgtacatatgtgatgttctggaacaggcaaatcattctttggtaaaagaaataaaaaaggccaggcgcagtggctcatgcctattatcccagcactttgggaggctgaggcaggtggatcgcctgagttccggagttcgagaccagcttggccagctggccaacatggtgaaaccctgtctctaataaaaatacaaaaattagtcgggtgtggtggcgggggggcacctgtaatctcagctactctggaggctgaggcaggagaatcgcttgaacccaggaggcggaggttgcagtgagctgagatcacactgcactccagcctgggcaacaagagtgaaactccatctcaaaaaaaaaaaaaaaaaaaaaaagaagaaatgagaatgtagttatctctgctgaagaagatggggagagagcttaactagaaggggcacaagataattttgcaaggtaatggaactagtttacattttattttgggtggtggttacagggatataagcacttgtcaaaactcatggagccaaacactttaatatctttttttattttatgtaaattatatctcaacttacaaataaaatcaagagtattagatggtctcttttcagtgatgctgtctctgtacagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacaggtagccttccatttattcatgccttcctttgtcccttcctctttctagaacttacagagtgcctagcagccatgggttggggtagtgcaggaaactcatgtttttccttccatgtctcaatggcttacagaagatattgtggcagataataaatttagttgagcttctaactgtagcatagtttttactgtcaaggagcatatagtttagttcagggaacagcaaagtataaccccacagaccaaatctagtctgctgctcatttttgtaaataaagttttattggaacacagccatgcactttcatttacatatagtctatggctgatgtcatgctacaaaggcagagttgaatcactgcaacaaagaccatatgatacacaaagtctaaaatatttactatctggtctttatttatataaaaagcgtgctgacctttggtctagcagaagaaaaaagaaaagttgtagttgattatttttaaagtgagataagtacaatgacaaatatgtgcataaaacaatacttatagtttcttgagcacttaaaataggccacattctattctaaattcttttatatgttaattcatttacagttgcaacagctctgtgaagatacattattattattatttacatgaaagaaaaggcacaaaaaggttaatcatttgcctcaggaccaggtaggctaggaaggagaatagcccagatgcagcccacggagtcagagttcagtgtcccccctttaactgctgcactcttatcctcaaggtagtcaccgggggtgtcatgagagcccagggcaagggtgcttgacccagtaaaaaagggcttcatggaggagattcctgagctgaatcttgagcaaggagttccagagtaaaatttagccaaaattggggtattgggagtaaaaagtgggtagaggctcacatgtagaataggtgcagagaactataaacacccgaggttttctgtattggaaaatatgaggcaggagcagtgagagctgcacatgccttactgaagggcaagagccctatgccgtaggtgaggaaaagcccccaacgaatgtgaggttgaagacagtgacagggtcagggtcctatttgacactgaccactctagagaccctgaaagggcatatttgagaaccagaaaatgagacagatgagacctgttaggagtttggtctgaatcagaacattagtggtgggaatatgggggaaaataaaaccagctaaagtagttagaaatgggggatgagaagaaggggggagcccgggtctccattctgggtgactagggcttgaatggtggcctggccatctgcaatgggacaaatgagaagtatcccagatcataggggcagacaatgagtttaggttggacacgctgggttcaaaggaactgtggaacattcagctagaggtgccataaaatggatggagttgagttattgaagatccagacttggagtaagcaacatataggtggtaataacagtcatgagagttgatgagatcaacccagggaaggatgcagtgtgcaaagaacagtgggaaaagaatggaatcctgtgcagaaccaatatttaagtggcacagaaggaagaggagcccagggaagagacaggagaagaaatactcagaaaggaccaggagagttgagggtgagaagcactcttgtggatgactttaggaaggaagaattgaacaaaaatgtcaaatgtagtaataaggactgaaaaatactcactagaggttttggggacattctcaaaagtggttgtagtagaatggtgggatagacgttgggctgaagaataaaaagaggagaaagtttgcatgagattaaagcaggtgagaggctgttttgtttgtttctgtttaggatggaagagacataagcacactgaaaagcagaaggagaaaggcaaatggaatgggagatgaagataagcgtggggtggccaatggagcaaggcccagaggtggtgggaagggggtgagggtgaggagaccctggacaagaaatatacctcatcctcggagattgggggacaggatggtgtggtcatggggtgagaagtcacaggctctcacctgtaatcaatgtaattttgtagatgaatcagggcataaagtaggaggcacagccaccagcgtatgagtgaggggagcagatgccaaatggaggcccatgaggactgtggtgaaggtctgaactctctaccaacctggccaagggcaagggaaggctcgatggagtgccgaggcaggtggtcatgaatttgaatcctcattggtctgagtggttctttggcttttctctaacatcacttggtggctagtaaataaataaacagggaaacgttttgtaattaccccatagctctgtctcttttcatggtcccttccctatagtcctcctcttcagttccttggcagacagaaattgtggtggagaaagcttgggtagttaggatgagcatagtagcaagcatggggtatatggtgcacttggggaagatggaaagaagagtgttgatacccaagagtcttacgtggcagaaacatgaaaggtggtgtccacatgggcactgacagcatggtgtgtagaaacgtgagagatgcccatatgagggttgagctggagggaggaaaattggtggcagggttgggagggttttgatgggtccctgtgttctcttttggcctttggcatcctgttcagaatatctcatcctcactttccccacggcctctgtcctgcttcagcaggcagatgtctgggatcttccctcccctgctgttgtgtgtcctgtgtcctggacttttcctcttgagtagccctttgcattgtagccaactcttgagttacagacccacaatctttgatatctgatgcactttttttctctgtgcagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaagggtaagcaaaaaagagaagctttgtcattagtgttgagtagtttttccactaaccacttcagatatgtttattatttgcagggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttgtgagtgcttcctctgctccacagcctcagaggctccagcacaggcttccctcgcgtgctggaacctttttcacattttgttctagcttccaaaactgggatgagggacaaaatttgtgactcacccagctccaggaatgacaagagggtgggagtttagggtaaaaaaacccagtactaagctggaccagggattactgtttggctcatggtacccccaaaaagaagctggaatccaatggcgagctctccatcagctgcaaggctgatcagtcccacacactcagggtcccttagccacagcctggctaagacagaagtgctgacctgaaggggaaacctggtaataggaggcaagcctttctgaacctccaagaagggaatgaattccttctgacaggagctaatctttagccactccagaggcccacaaggggaatctcaaagtccagaggttccttatttacacagctattacacgcagtatgtctctttgggacatgtggattatgatgactatttttaaaagtggggctatcccaaagaaaagatggattatttgaagaatttttaaaattgttgtcataatgctttcattctaatatcagctcactgtagtatccctgtgagctatagttggtttaggccacattttactgttgtagacactgagatacaaatatctaaataaaaaacaagaaataactttggtaataaggacgaggagcagtcctcattagaggttttagccccagaatttccaggctctgggcacctcatccactgctatctcccactccctcccacccaccatcatgccagccccacagtacagagggtttctagagagaaggcaaacaaacatcccccccttttctcttcttcgttgtcaagaaatgaacaaagtaaagtggggagggggcatcatatcacgtgatcattggagaggggaaggcagggctggaggctttggcacaggacagggcagatgggtctcagctgtgcctggctgtaaccccacactgctctctcccactcgttcactgagggttcccacacttcttagagaaacagtattccggagcaaggtctgagtcagtagaatcaaacccactttcagttctgagctagggaaaagcaaccctgagtagaaagtgaggaagggtgcctcaactgggagccctcagaatggagcctgagaaagaggagggagggtaggtgtgaaaggagggcaggggatagcagcccccatcccccgaggccccagtcagtgtctctgtgcaaattaagaacaaggacccctttgtgggctatggggtcgacagcccccagacatggcttatcatagaggaaaatggcaacctctgtgtggactgaggtcagtcctcaccctgaaccccttggccaggtgcctccatgtagagaaaactgcacaaacatatatgtggtcccaggaaggaaggatcccaacccttttcatgcttctgtgcatttcccagtcccctctccctttccccagcagccttggatttcctgctgtgagcctcagccaccaggctctgggggagggtgagtctgtctctccctgcctgccttcatctgcagcatgggggctctagcaggaaggccaggaactctcaggggagacctcatgcagatactgcttcctaaggaaccccattaacttccggggtccagggtgttttctcccagtgaccactgacatctccatgaggcaagatagagcctctcaaagacagtgatgggggaggggcatggaaacactgttatgttcactgatactcttttcacatgggtctattccctcagattatctcccatgggacacacacgacttttttgggggggttacttagggaggagcagcagcgagggcacttcagtgattctagtgtgcagtcagcattaagaactatgtctaagaccaaagcaatgcagaagaaagggccctgcagggtctttcttgtgccccactccaccctagcacaaaaagacccagaaggtgacagaaacaagaaaggatagtgtccaggagagctcttcctcaaatgagcctcctctcctccacttcgttctcaagacagtgcatttcctcgttctaggtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacggtgagtgcagcaggcctggtctaaaatacttccagccttgcattgctcataaagacaatcggacacttcagaggtcacttcataggcagtgagaaagagccgggaagggatagcacaggtggagtttggtgtcccggggcaggacgctactgacttgcttgctgtattttgaataaactgttgttttgagcacccctatcccaggtgtcccaagggctctcattccggcagggccatctatactcgcttccaaaagaatctctaataccagaaaaacgtattactttctgtgcatccacaaaacaaagtttctctggacagcgtggccctcagtagcttgccttgtcttgctaaggagagctgagacttcctcttcctgcactatctggtgctttacagagacctcagggcattgacacttccgcagagtagcccagttactctcttctccactttgtcctgagggtcgtagggacaggagggtttgcttaattcatgcttattctggacggccttggcagtcattcagctccctcagagccagagccattctcaggactgacaaggcttggtttttgagtatggagtcacaaaggaataatgaagaaccagggatgggtggacaacatgaacccctgtagcagcagctcccccatctttttctagaaccctcatgctaggtgatccgtgtggagttaaaagcggcacggccacagtatagaggggatcacatctcatgcattttctaaaaaccatctctggtcactgagacaatttcttaagacaaatgaaatgatccatgtgatgagttagaacagcttaataatccatataaaaagtctagctctcgttatctttattagacaatatctctaaagttgagtgttgcttgagcccttggcattggcactgccctgatgcccaaaggcttccctctagcttgatcctagaacctgaggttgagggaatgaatagcagcctcctgttcatttcaggtgagaggagacagagcaaaacttctctcactctgatcctggggtcagatggacatttgcattctgggacatgagaagctcaaagcaaagtttttgccattgcctggaggcatttccctcccgtccccactcctctccttcctggagttgcatgtttctggcagtgcccaaaaccctgaatagttgtccaacgtattacaggatagaattataacactcataggtccatttgatagtgttccttggaaaactgttgctgctgcaggaatggacaaagcatctagtcactgtcctgggatctgcaatgctcactgaactaaacacatgagattcctgcctttgggcagcttgtggtttagtagagggaaacagacaattaacatgtaactaaacaaataagatcattggggtagtgatgaatgttaagaaaaaaataaaactcagtagagggccagtgaagtcttctgagagggagcagcatttcagctgagacttggatgaaggaagaaaccccatgtggctacctgggtaggggcttccaggcagcgctgtgcccaaggcagaaacagccttggcaagttcacaggagacaagaagaccagtgtgcctggaaagggctgcaagaggaagggagacatagggatgaaatcagacaggtgtgtcggggcctgggacagtcttggccttgagactgcttatcaacgtgcaaaaaagcatgagcatgaaataaggggtaggtgaggaggcgctggggctcccggagaccttcagagggagaacggctctgccatttgaattcctaaatggcggttccataaacagttcagaagggaaggtctaaaaaactctttatgctccaggaagatgagtaaattaatttttcaaacttctgctgcgtgggagatggggaggtcctgccacagggaccagcagggctggatgtcttgcttagaggtgagagatagaaatttcacagcacctcttctaactgtggctttcctggacaaaaagcaacactgaactagagaaggaaaaattgaggccacctcagttttggggggaaactcgagcggtgaactggcatttttttggcaactactttgtgccaggcattttacccacattatcttatttacacaacagttatataaggtcccacaactagtaagtggaagaaatagcatttgatcttcatttcagacttgtttgtctagggcagatcacgtccgtgtgagttcattttgagcatcagaccaagacaattccatagtttccctaagtggtggccactgcacttgaactgcttgggttgacaatggcccagccatttgtctctcagatcctctgggccccatctgaacagatctctgattgttcggtgtgattagcaggtgtattaatgaggaagcactcccacactgtgggttcatgacagactggtgtgcaccaggagtgccactggacccaaagctacccacaccgagacgtactgaaccagaaactgccctttcacaatgtgccccagtaatttgagtttgggtttaccactgacatgggcttcttcctcatctttgacagttggcagcagacatagaatttagcagtggaggactcatgccacctgctcatgggagctgcctcttcactgtggttcgggtcccggttctcatgggttttcaggtctagctaggtctcctatatcatgcttagctctgaagtcagtgaaggctgccagagggtcactgtgggagcccccagcctcgtcactacccctgggccatcctgcccggcccctatgtgggcatcgcgatggggaagtgtctgcatcagtagccatgacctgtcaggactcctcagagaccaacctgcttctcaggctccaggcagctgggtggacgttcaagacttgcttcgttcatcatctctgccaccaatctcaccaggtggtcacctggctgccaaacatgatggctcttcagtggcacaccattccatctgacttggccctcttgggtgggaaacgggcactcctggccccctctccccggagaggaccgtggatcctgacaaagtatctcagagtcttggtagcctgtgcagctgcagcgcacctagacttctctctgctggccagctgaggcctggggctcacgcgtatctcgaccctctttaaaaagggggccacagggagtccctgcaaggcccaaccaccttctgccagggcagtagggagcgctcagcgggacccaggcctgcaggctgcatggaggacctcatttgcacttcaataacatgcttttctttcacttaactatatatcttggtgttagatttgtcagtggagagactccctagtgcaattaaacgggagtattgagccggagagaaatcagtgtgtgttgactcagatatttaagcaaccacctttcagtattgactcagaaattggccttccagctgtccctgctggcagactcttctggcatctcgtcaggccgctgttaatgtgtttttcaaatttcaacttgcttcaacttgtctcctaactgatcctcctgttgatgacaataatggtttccaggctgacctgcacacagcacttaggcaagcagcccaggcccctctctggaggcgaccccttccttataaatcacagtcagagggcgtctgcttgctgggttcatggcaggttaagtcagcttgggggacttctcaagcaactcctaattgttcctctggagaacttgagtggtgagggtctctctcctgatgaggttagactttagcggtctgctgctggaggggttgggttgctgattccctccaaatttcactcactcttccaaacaggaagaacttttccaccatttgcagtctccctgatgagtaattattggatgggtttgtggtcacttaattaccagggcccttgccccttgctttacagagtcgtgactatacgagcacctttcccagacgtggccaattagggggggcccagctggtttggagccaggcttctaaggaaggctgggtccctgttctcagctccgagccctttctgcagcctctctcagtccttcctaagtgtggctgtcaaactttgctgacctttcccccttggggctaatgagtgtcacagctatttttaaccttgggttttctagaagttgagccgttaacctagctcctacagaaggaggatcctgggaggtataaatgaactcttcacacacaaggaggtgactaatggaggaacataggattttcagtgtcagggctagccttgaagttttgtgttgacacccttgatagcatcgaccagatgtcaaatcagagctggtcagcacaggcggcatgggtgggagggcagccagaccatctgtggaacaacctgttcatagtatagacggctgagcctcacctgagagggatttggcaagtctgcagtagggctgtgactggttcgttaaccaactttataggggattctgatgagccaactggcttggggatcaccatcgtgatggaaagggcaatagactgaaatcagaattccaggtcctggcagtcagcgacctgtgtgttacttcgggcaagtcctcttcaagacatttttctcatcctgaaggcaggggtaatggcgggccttcttcacagggttgctttgagaaatagatgagatagtatgtagcacctgaaaacagcagagtgtcaggtgtgcggactgctgagtcacttgggcattcattcgcttaacaaatatatgggtcttaacacaaaactgtaagaggtactgcagaggtttgtttttttttttttaaatacgatctgttgtgtgcgaagagcttcagacaaatgggacagaggaatccacatgggaagtcaggctcccagccttgtgcagggcgctccagcatgacagtgtgcacaagtgatgctgaaacacacactgggatttggaaaacctcttagacaaggtgcatgcaacagcagaaacaagaataggcaaggatctgctctggtctctggaaaatgtggggacttctggaagctgggaatttatttcctgcacggcatggcctcttttgttcatggatggaaagaggcaaccaggcagtgtgatcctagaacagccaccccttccctcatcctggaaatgccactgcactctttgtatcgctagggtagaagtatacactcactggtagaatttcccctaaaatttcatttttggaatttgtgtctcttttgtctgttcacacatcccctgctcttcctctaggatgagggtgaacgctgggaaaactgagatggaagcaagtgggagcggtacagggctctgcacaagtggagaccacacagagcaaaggccagtccagggtggggagagaggtgggacggtggcacaagccctgtgctgtcaaggaccaggatggggtgaagcggtgaatggggtgaagcggtgaatggggtgaagccgtggtggtgcagggccctggagaagactgagtgcctgatttcaggctcaggccaaaccctccaccccagtcgtggagaatcagtgttgaaaccaagatgtggtcttccatatcttattctgtttagaaggttagaaacagatgcagaaatgctatgaagtgattatcttaatggcaattgtaagaatccttcttgtaaccccatatcatatcgtgtatgattcatagagcctgcctgtgataacaggtgatgatccacatcccacctctattccccaaggcaacagcatttcctcacattccatgctgctatcgctgcagccactaccacccccaactccccagcctccaagtttgtgtttgacaatctcacatgataggtgttttccaaatgggaagatttcttctgcaaccattcttttcatttaatctgttcttgatctacattgagatagatttctgtgctgattttaatactgagctatgtgatttttccaattaaagactatttgtttatttgtattatagaagaaatatttaatttttaataagtatggataaaccaaaagaagaaaaccaaagcacctataattacatcattcagagagactactattaaaatatgggtcatatcttccctgacttttatatgggaggctgtgtatatgtgtatacagacatgctttttcttacaaaaatggaattgtcatgtatatactgttttgtaatctggcagggcatgaatttctttcctttgaacatttaaacacttaataatactgaggaggataattttaaaaagatataatgtgcttcacatggtacccttatttcccatgtgacttgtgctattacatacccccaaaccacttttacattgtaccaaatgaaaatcccaattatcttatactacccacatctacaacacactttggtacccttgatgttccatgagtcctgaagtttcctctaaattttccaagaaagactaaacttgttcaagttagctttggtgcttagagtatcccaggtgtctagatgtcagcaacacatggaagatgtaccttgtaatttctattaattggaaaatgtaattaaccagaaggctacatttcccaactgtgcacaacaatgagcattaactgtaacaaaatgatggtactcataggcagtccttgggggttgtgaacaatggttttgtgggagcgaaagatgatggacgagaatccatctcaagtaaacaaaattcttccagcatctggattgtggaactgaattggagtagaatgtcaaacatatatgtgtgaaaattccaagacagccttgcagttctgcgctgaccaagtcttgtttgaattgtcagaggcatcaacccaaattgatggagtcaggtttggcttgtccaactttcactgtgctgtttcagttcattttctcagcacagtcctagctgattgtcctttctgtctgttctctgttcactctttagggagagaaaagggaaagaagaaaatgaatttaaaggaaataggagtagaagtggaggagatggaagatccagttaagatacaagtgagagaaatgaaaaatggtcaggctagaagagagaaaaatgtgctatgaggcaggagagatgaatcaacgctgaaaagctacatttctgagaagagaaattgcaaggggaaaaaattagagtgttgaataaagaggagacgaagatatctgtaaaatattgtttcctagtgttgagcttactccaaaataccttatgagaggttaggccagaaaatagattattccttttggttacaaagaaatcatggtgctctcaggaagcaagagcagatcatgaacacagcctgacagctgctgggtacagggaatggtttcctttaccgtatttctgctcattttagcaattccagccctttccagctcagttttcattttcactagagtgacctccacttttcatacaattacaaacatacaaaacaaataagttctgggatcacaacacttttgtggatatttttttctctcaaagattcttataacatttctttgagttgagggggagacagatgtgttgtgtggtgttgttttacatctggagaaactggggcacagaggagtattgggggagagttcagctgctctttgtagtgctgttgggtggtgatggatgtggaggcagatgaccaggtcttctcaacagaaaaaaattacacttccatctgtaatcaactcattttttctctatttgctatgatgacaaaacaaaacggaacccaaatttcacaaatacactatttttatcatttaacctgcatgtttccatttttgaaaaatttagttctaattataatagtttttacatctcaaaaaatacaatactgcaataaactccataattcaaaatgaaagagagtattgggaataataaaattagtagagaatcagcaaaaagcaaaaacaaaacatcctgtatctgaataagtaacagtttccaaagagcataaaatactgctgaatataattcagtcgtgtgtgtgtgcgtgtgtgtgtgtgtgtgtatgtgtgtgtcagagagagagaatatgtaatagcaatcaaatgaacatatagctaatgatatctgtacttagctaactctggttgcgccataccctataaaatgtcacagttgagagtttcatgaaccttgattccttttcagattggccccaatatatgcatgagctaaacgcttcctgtaaatcattgctggaagttgcctcagtgacatggccctacatgtcccaggaatccccctttctctgctccagggccctctctccaattttcacctcattctgggcctgagactgagatgagactggggagaggtctggtagccccaaattttccacatgtatgtcatcactgacattcctcaatgagcagtgcattagcgaatggagcctgtttctgtctcattgtttgtgctcttaggatcttaaaacaaaaccgatcactaatccaggttcaggatgaagtctgagtgctaacagcctctaatagtgaaaaaaaaaagtcatccattattttgggaagagaaggccgaagacaggagcccctcttgatttcccgctttctataatactagatgtacgtgagcctcagacctaatacatgcgcctttctgaacttgaatatctctgggacaatgatttatatttttaaaaaaggaaatggcaatgatatatgactttaaaatctcagacgctgcccttccaaatgaaactgcagggaacgcgggaggagatagattcagtgtcctccacccggcctctatcccattccttctctgatcccactctctctcttgccttggctcacagtcccggaggcggtttttctccagggccttctcccagggctccctcccatgcttagaaatactaattggcatctttgagtttgtgctctatggggcattgcgtgactcacttggtataaatcatctagtttaatgatcataacaaccctggaaggcaggtgttatttctccatttttcatatgaggaaaactgaggcccagagagcttcagtaactcatccagggttacaggtcaagtagtggcaatgctggctctgaccttcagcctccgtgtctgctgctcagaagtcacagacagccacaggccagaagacaaggagacttggtgctattgtgtgagttatgcagaagcaaagatgtgggtatgaccaaaaagatggcacagggcagttcaaagaactcatatagccacaaggcagtggtctgtccgggctgtttggccttggctgtgaagaattcttcctgtccaggatcacactgagtagaaaaggaggcccgtagtgtccacacgtgttccccagggtctggcccagacagacagtctgaggctcgatcacttgctcacccctctgtgttctttcagctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaa

SEQ ID NO: 145 - DNA, 48670 bp, Homo sapiens
ttggctgggaagaggtggcaatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatggtaagtgctctcagccgggtgcggcccgaacctcacccctcctcggccggcctggcagcgagggaactggccgcgcagccggagcttggctcgggggccctgggcgctcactgccggccacgggagcagcctcactccttgcccgcgcccagtcaggggaggtgggaacgccgcgagtcgtggcgggggcgatcggtgcctttgcttcccaggcgggtttgccgctccacaccgcagcttcctgagctcgggaaggggaggtgcggcggaggcgtggggtcttcccggctctggccggccccaccagtgtgggaggctgagcgccagcggaagggaaggctccgggttcgcgtccccgcgctgcccccgatgcccagcctctcccggagcggtgacaggtgaggagggtgggaagatagcgtgggggtggggcggatggtgacggggagaatccaccagggattggggggttgcgcccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgctggtgatccgcaattacggccccgaggtgtgggaagacatcaagtaagtggccggctaccctggctgtggcccaggtcggcgcccagtgtgggaggccccccgcgcctcgcctggtcctcagcctgctggccgggtcgcgggcgcgcatccttggaggtgcctccgcgcctcgctcccggctcgctgcagctgcgctcccacgctccgggactggaaccaggaggggaggggcggctggggcggggctgcgagggcgagaaccgcggaaaggagcccctaggggtcaccacggcttcccgacccggcctgagcgtgggaacgcgctgccggcgctcccaggctcagcaggccgggcagctcccacgcgtgcagagccccgagggaccacacgggcctccgcgaggttcctgcgcccggaggccttagaaacaaacggaagactttggctcctttatgatttacacacctggcgtaagttaggcctttttggtatgctgaaacacgcgggagattatttcttgagcaacagtgaattaagcgcatttattcatttttaaataaagtgaaaattggaagttttttgttttccccaaatcccactgcccaccccccccgccccaacccctatcccccgtttttttctactgtgttgaagacttaacagttctaggaggcattctactttcagtcctggagctttgagcccagtactggggatgtgaacggaaataccacacccacctgagagtttaaacctgttggaatgactgatgggtcagcatgtctgcaggcaggttgactatttcactctaataaagttgtctctcctttttcctctcactctcaaaaaatttgcatttaacttatggtacagctgaccaccaccaactagctactccaaaaccctatttatggattttcatattagagcaacagtcagactatcacattgtaacaaaggtggaaggaagggtttcctgggtgggcagatgggaatacactgttattattcactctgatttcctgtacttagtgatttcattttgttgtctcaggtaggtgaggcttccatgctgtttttccctaagcacattacaattattagcaatcaattctaacaggccttattatgcagttacatgatggtgatttctcataacgatctgtttccatagaaatgaccagggttatatattaagcacgaaaatgtaacttttctttcccctggatctgtatcactgagcgtttctttcatgtttcagaaaccatttgtattatccacagggcatattacctacatattataaacagaagccgagatttggcaagtatgtggttgaatccaatgagaacataggcaccaaaagttactttaggatttgaattttctggccatcttaataccattataatttttattttgcttagtagacagatatcaacaaggcagacatcaaaaaaagattgttaacagtataacttaactaccgaattatttttaagccacttcctttgtaaatttataaatgctatatatatatatattctccatatgatgcttttgcatctgtaagatagaaattcccaaatttgctggtagatatgctatgacaatgaatatgcttagaatttttagagcagaataaaagatggctattatgattaaacagtcattatgtaatttaaccagatttagattgtatatcctagccattatcagtttagatcactgttaaatacagagatgaaaaataatactttatagagtaatgtatcagacattttaaaaagttaaaattatccagagatttgtttatattgcttatattttcccagaggaagtccaaatatgtaaagattcaattgacgagaatttaactctgcaaaatcaagctgagaatattgttccattctactttaaaaaattatttattaacttactaatttatctttaagtagcttccaacagtattcataatttgtctaaaggataaaaattccaatcatccacaacacaatttttctggtaaaaatgaaacaagttatattggtcttttcttaaataaaattgcctcaaggttatgcccctgcaagggaaaaagtgttagtcacactggtgttggtaatccaggtgttagtgttgattctttatttgtctaagcatcttttggtggaccccagctgatcttgggtgtggtttagtgtctgggctagagaacatggttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcattggtccaagatgctttcagttttaacttttataagaaattgaatataagaggaaaaacatttttttttgtctcagtaagtaccaaactcttattttttcttttggtctttgagaaactatctaaattgatgtttatacaaatttacattatacttttttgcttcactaggaaatggccatccatccttcatgagaaaggatgggaaaagatgccaaacatttaatgacaaataaaaccctaagtaacagattccagacagcagacagaaaattctaagtggataagggccaaaaatgcttcattgtaaactcagtatccacttacactcttaccaacaatataaccatttcacaaaagctttgaattcctcttaagaagaagaaaaattgtctagaccaagggccagcaaactttctcttaaagggccagatagtaaatgttttaggtgttacaggccaaggtaaaactgaggatattatgtaggaatcaatataactattaaaaatataaccacttaaaaatattaaaaccattgttagctcttggaccaggaaaacgcaaacaaacaaccaaaccagacaaagtgggctacatgtgatccatgggctatagtttgatgacctctgatttagaccataacaaatgtgaaaaagcaaaagagacctctgaatccatttcaaagttttttttgttgatttcatttcaatattcaaatagtccttttaagaggctatgatttctaagtaatgacaaaaaaattatcagggtagaaaataaataaagttaggagtgatacatcctagaaaagcacctaaatacttgatttcccatctctgttatccttccatcagccctgactaaactcatcattgcgtcaaattactgggtttaattttagattttttctctgctttctttccatattttttctgggtagcagcggagggaagcagttagagacaggtcttgctgtgtgcccaagctggtctcaaactcctgtcatcaagtgatcctcttgactcggcctcccaaagtattggattatatgcaccaccacacccagcccaactttagattttttaacctcactgaaacatacaaattaggaagatagatccaaaacactgaaaaatcccaaatgattaaaagtctgtaaagaaagtacactgtcctgacttaaataaatcagataaaacgtttatctttaatgagtatagtcaagtgttttaggcactgaggatagaaaagcaatgatgtaatccttaccttcaaaaaaaaaattctagagatttcatgatattttagtcttattattttgtttttattttcctgcctataactcaaatacggtaaccttttgtctgttggatagcatatacttccagttttgaaattaatgtgtcttgttaaatttgctaatcacaaattaatcattatggttcaaataaggaaacactttgctataaactagttatgggactttccaagttgcctaaactttccaatcctccattgcatagaggaaaaaataatacttcacagagctgatgtaatgcattgaataatgtctgcaaaatgcttaacatagttcttgacaatagcttaataaatgatgatttttttttattttactctagaatcagagtttttaaactttccgttccccaatttacttgaaagatattaagccctcctttaaaaaatattattgcagtctatattctatcagtctaaattttttttatcactctaggataagtaatcatcatcatcatcatttttcatcattttgttttgaaatgcaacaaatgctcttaatatccattgtatcaaagcaaattaaaacaaacaaaagagcacatcaccatgttttgccgtgtttattcagattttcatatttttgaaggtgtgatttaaacttctatacctttctgtagatctgcttaagtagtaatgagcctatgtatgttttaaagtagtaaggatactttatattataaagcaatttcaaatttccaaagttttgttctctctataattttggttgactgctacaacatccatttgaaataggaaaggactttacagctcaatttttttaataacaaagttggttttccaagaggttaattcccatatgtaattacttactgtcccagagaattacatataggaaactgaaaagtcagaacttcagcccttgttcttctgttgccaggtttaatgcttcttttaagatataactgtgaaataggaactaatgtagtatacatacaaaaatgaaaccacatttattttcttacccagaaacttcctcagtacaaataaacacattaatatacagactaaggaaacaagtaaaccagatcattgttaggatcaggatccttttctgtagaaagatctgccagttagcctgaaatacagaggaaggcgttgcattgtattgtgtgttggctgttaagcttactaatgtttgaagttatcttttgcagctggaactggatgcccaagtgtatactccatcacatacctgctattgagctctttgcatagggctcttccagaacctggaccatgtctgtgagcagcatggcaggcacctaggtgataaggcgggtcatcacatgatctcagggagtttgtgggtgtttcttttgagttttattttggttctgatgatctgaggtatcccccagaaatcaagctgggtcttggagtctttattttccttgcattctgtgatttttgagaattaaaaaaaaaatcagaggagtacatcacttaatttggcgtgtcggaaggatctttgcacattacggtgagcatcagaaatcagaaaatctgtattctcactcttaatgtacccagatctagttttggcaaacatttactaagcattgttatgatttgcaagaacaaagtcctttctactttcttgcctttctccagaataaggggctctagcaaatgtttctctttaatgtgttggaaaactatagttatgggttgatgctctgcagacatcaataggaaaacacacttaaggaaatgaatgctataaagaaatctaactggctagatccgagggtgacagctcagcagacgtgagtacttgcagctttttcattctctcctttgcctccttgttcgttaaagaggaaatggtgggagaaaaaatgtctttattgtttatgtctagcaaaatgaagcatctttttctgtgtcaaactatatcaaaagatagtgaagttaaagtggattttattccaggtaaaagtagacattctgaagtatttattggacctcctcgttactgtggctttggttctgttgcatattctggtctacttccccttcattgttgaatcatgaaatatgaaattgttaaatttattgaaattctttgtggtcaatcttcagataacccaaacatggaaacctttcactcaacttgtcctacatacccttagcattccagccccatgggcctgtttttagtttctcagccataccgagccttaaatgtgtccgtttaacacctgtgcttgctatggtctccttttcttcaccctcccaaccctcctgtaaatgtaaacacctctcagctttgagatgtcaaagcaaatgtcacttcttaagggaaccttctctcacatccaaacttttccctttccttcatagtgctgtaatgcaagagtttgtacttagtatttgtactactgattaatgtctatcctccatgacaatagcctccataactctttctagagtgctctctctctccctctctctatgtattcaataaaatatcaggctctctttctgtaataaaaatatggatgtttatatgtgaatgaagtatctttcacctttttcatttccaaagaatagagcacacacatatttttatcaaagattcttctctgcaaccagaatttatgtcagcatggtgacatattcaactactatttaaatataagctgttttcaaatagacatttctttttctccaagatttattgagatataattgacaaataaaagttatatatatttaaggtgcacaacttcatgttttgatgtacatatacattgtgaaataatcactgtaatcaagccaattgccatattcatcacctcacataggcaccctctttttttgtagtgagaacacttaagacctcccctcttaacaaatttcaagtattcattatagtattgttaactgtaattgttcattgtaattgttaatagtgacattgctgtgccaaataaacatttcttatatcagcaaaggcagaagatagagcaatatagcaatacataatagcaattccttttggaagtgtcagagttcttttatgttttctcatgtcatgtggatgtattggaaggactaagaactctattgttagaatgacaatttcatatgtcaaaagacaattactagattggattcaggacatgattgaatcctttagcaagtttctaaaaggcagggatgtgtggtgctgtttaaagtcagtgtcatagactgtaactcagtgtttagaatactgaaattaaatttgaaatccagctgagctctcaccatgtcatgctatttcgaatgtaatatgtcacgtatattaaacacataccatatggttctgcagtcacagtcctagatgctttatactcattatctcagttaatcctcatcaccaccacagaaaatagattccttcattatcctcattttgcaaatgagagaatagaggcgtaaaagaaagcctgcctcaaacactcagctattaattattagagctgggatttgaacacagataaagttgtaattatcatgttatgtgttttcctccaaagagaaagacctataaccttcttctttccaaagacaaccaatttagcaaggacatgtgccatgtttatgtgtattagtactgcctgctgctttttcttttttcttggaatgttcaagcatgcgtacaggtgatttttgacaacaatatttttaaaggcgaattgacatgaagcatatacacaagtgtctaagtaaattcatttgtctgttaaagctgctgaaaatggctcagcagctcaaatgaagatttgtaagttttgtggatatgttttcaaaattggagaaattaccattaagggtctcttgtgactcaaaattggagaaattaccattaagggtctcttcctgacaattgcatgtcaggaagaaacatgcaattatgtatcaagactgttgttgtttcccctaaaactaaggtatgggtgtcactcaggagagtatttattgttactgtttacagtgattggatgagtgagtgaacacattgacatgaaaggactgacctttactaactaaaagggggttcaggcaggaagtcgttactggatttaaagggcctgtctctccacttggcagctccctcaagccagagtctctcctttggggttcaggcttactgagaatcattagattaggccattgaaaacttagaggctattcatgctccacagccacttagaaaaaagcaatataaagttttacttttttagatgttatatatagttactatccacagtttatagtgggagattttagttttaataatggttggggacaatgcaacattatggtaccaattcagctcactacaatggaccattctaggatttattatcaaaacgacacctacgtactgttttttaatacagcatgtgttctgataatgttgtttatgggatcaatagtatcttggagctgtcattggtcagtttgattgtttgatcctgattgaccttttctgcccaagagcagaccttgtgttgagattatgttttcaacatgcctgtgttcaggctctcccatttcaaaatactccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataataaaaaatattctttagtttgaaagcaaatgatggacttttgttagtaatgtttgattacttgtttgttttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccaacttaccaaacaccaccactataaaaataccaactacctctttgtgaaaaggtaattagtataaataaaggatctgcttaaattccaacaaataagagtaagtaggaagttgattgctactgggaaactatttcacttatacgtattcaacttctaaacagttactgtggctacagatacaaagaatgtgattatttctgattttgttgccaggtgagaattcgatctttatttttaaagcccttaggggcaacagagcttgtttgtttcttggctattttagtttgtaaattctatcagcaaatctgcatactaagtgcaccttaattatttgattctgactaaaaatgactaagattttgttgtcattcttcccttctcttcttccacttgccatttcctctttctcctttttcccttcttccttcatcttctccaactactataacttaccagttagaggaagtatcaggcattaagtgtgcaagaagtactaccctgagatttttgcataggttaattctgctaaccaacacaatgaccggaggtaactgctgctgttagcctgttttacagatgaggaaatgaaacaccaagagttgaatctgcccaaactgcacatgggattggcttagttgtttattttccatactgtgtgaggaaagactttgacttatgacatagatgaaatcaagggagtttctctttatctaggtttacttgttagccaatgaaagtgcttttaaacttgaacctctctaaatatttattattgtctgctgacctctttcattgagtaattcactgaatagaaaaatttaacgcttaagccaagcagagtcattgggtatgtaaatatggcaagtcatagtatttgaaaatagtgaaagactatgttcacttgggatttggtaggacttttaaaaataaaaataatagtagtaagcagcaacagactgtaatacaaactaggaggcatgaagattgtagtgctgttggttattatttgatagatgagcactcttgaacacagtttaatccaatttacttagagtttatatgatattttttgtcatctaagaagcattgaaaaaaatgacagtatgtccaaaattttcagaaaaatcttaaattgtggttctcagggaaacctgtggtttttctcacatgtaaaataagtacaatttaaataataaggtaattgcataatttccctattatgtaattatataattacataataataatgtaacaatgtatacataatgcaacaatttaaacaaaattggagctcaaaaaataattctgaaagaatgaatgagtctataaaatttggtgaatgtacttggctgaatttggataatttaagcccatataaattctacttgtcacaaaaataaattttaaattactagaagtgttattcttgcctttgctcttgaggaaagaacttaaaagttatgggatagcaaagtgggagatgcagaattatgagataatattacttgaattatgtaaattgtttatgtaatctgaatattagcttacttcctaacttttcttaaatttactggtcgccctctgtgacttcaggtagcagataaaaaaacagccctaaagctaaggagagaaggaagcctgcagtgtgggaagggaagccattaaaactttcctcaaagaacagtggcagctatattttgcagagtgctgggaaatggttattatcacatctctgtgctttctggaggttaaaacatttgacagcatgaagtccgattatatataaatttacctaaaagttagaagaaaagttgtattgagaattgagagacaacagagaaggcttggttgattcaaaatttctactagcttcaaaggccatattatctgaaattaattctcttagttattattccttcattgtatattctccatctcagtttagtgtattaaactgcttcatactaaagagtttgcgatacctccaattaacttttgcagtatttccaattagcttttcccctgaaaggaaagaagatgaagaataggctagagaaggaaaggaagtggccccagaaaggttaggtataaggtggtaaggatggaggtttcctgctcaagtccttgctccggcgtcactgtccccatgaagcctaccatgaacacctatgtatattatcctcatatgtatactgcatccagccccttcctcttgcatttccactctcatgtctttatccagagctacctcttcctgtagtatctattgcttcataacatattatatcattttgttatatatcatgtttattgcttattacttgtatctgtcagctaaaatataagctttatgaggacagggatctttacctcttttgttcattgatatattaaaagtgcttagaaaagtgcttggacataataggcatccaaatatttgtggtaaaactgttccataagaaaaaaagaaaaagaaaaagggtagccccacattcccaaagatgtaaatagagtcctaagtactttgaataattcaaaggaattcagagtgaaatttttaaaagaagattattatttccttccatgtactactgtttaatttctatttcagtccccactggggagcattgacactggtcatttcaggaagtaaagctttgatgataagggagcttattttaataaagagagagaaaggaaaggaccaatgcattgacccatggttagggggtttctgaggaaatggctgttcccctgttttatgcagagggactgtggattctgcttgtaccttgtttatttatgggttactagagattggtgagtgtttcaaataaacagagtttattacagaaatttatgtgatttgatttattccaattggaagaaacagaatggtgaaacatgaataaatttctacttattgtatctttaattagaatattctgtcagagtctccaaaattttaatctatagatcagtgttgtttcaaaataaaatgttaatagcaaaatgacaaaacataaggtatccatatccgtcaaactatttatcccattcctaagaatttgttctgtttttacatagaagtgtaagaagctataaagatattcataacattttttatacttgtggaaaaaataaaaacatctaactacctaccaagacttcaatatgtctacaatgcaattttatgcagccatggtatagaagtataattatgatatgaaaagatatccatcaaatattcactcaaatgggttttaaagcagtatgttctatatataagtatattcaagcatgaacaacttgaaaattataatagcagtgattatctcaggatagtggaggcttattttctctttttagtttttcctttcctgtactttatatatatttttacaattagaaattagaatgcagaaaatatatagtagcatttatcagaggataagacaatgtttgtatattacgttttcataattttttgatatctcactgacttttggtattaaaaagacttgaggtcttcgaagagttgtgttgcttttgtttaacagctgtttatgtttggaaaaagggagaagaatttaatattttatgtacagtgctataattgtttgagtagacatggggagtgctatattcactgggaatatgtatagtactttaactgcttagaatatacttttgtacactttatctctttactgttgtgaaaggtgaattatctgttgcttccacttcagaaaagagaggttttgtttgtttgtttgttcgcttgtttgttagctgagtcaggatctggctctgttgcccaggctgaaatgcagtggcaagatcacgcctcactgaggcctcaactcccgaggctcaagcaatattctcccacctcagcctcccaagtagctgggactacagacttgcgccaccacacctgcctaattttttttttatttctaggagagaagaggtcttggtatgtcgcccaggctgttctcaaattcctgagctcaacggatcctcccacctgggcttcccaaagtgctgggataacaggcatgagccaacctgcccagccagaaaagagagattttaatgcttatgtgctttatgtgatttgctccggttcatttagctggtaaagcctgggctctgaaatgcagatctctgtgcttacagaaaacatgcttttaaaaaaaaagttatgaataaatgcaggcaaataaattataagctctgaaggacagaggatgtttttaagactatctgcatactaaggtatggatgtaagacataccaccatttggaatttttcccttgagcatacacagatatagtcatgagtggcagctgtgatagcacagcttctgaaggagagaaagcaactaaggactgccttgaaaatatttaaggagttatttgagctgctgtgttgcaagttcgcctaattagagtggctactttcctttgtattctcttggcaatgtacagggattccgatgaattggattgagagtaagaggttgacatccaagctccatgtatttttgtgaagttaacattggcaatgatatctggaacttagttcttttctacagttggccatgtgggtttttttatttacatacatttatgaggtacatgtgcaatttgttacatgcgtagtaggtggcagtgttttaaacaatggatttcacctctcctttgaatgcttgtttgagaaaagtaattcaaatcctatctaaataaatacatttatataatcatgacaacttttaaaaacaattataattttctttcactagtactgtgtatgttttgagctactgtgtttaataagctaaggatatatttgaagattttatcagtccacttggcatctcaaacttaatatgtttaaaaacatctcaaacttaatatgttgaaaacatagctcttgaccttgaccccttgtccgcctccaacaagtctttcccaattcagctactggtgacaacatccttttagttgcttagaccaaaaacctcagtgtcctccttgagtcctctcttttcacaccctgtgtccaatccatagcaaatcatgctgaatttacctttagaatatatatgagtttgaggcatttcttacctgctccacgggttcacgccattctcctgcctcagcctcccgagtagctgggactacaggcacccgccaccacgccaggctaattttttgtatttttagcagagagacggtttcaccgtgttagccaggatggtcttgatctcctgacctcgtgatctgtcagtccccgcctcccaaagtgctgggattacaggcatgagccaccgcgcccagcccaccaacacttcttacctgaatgttggcagcagcctcctaactggtctccctcctctgtcttgtacccctttagtctattttcaatgcagtagccaggtgaatccctttaacctagagcagtttatatcaccactcatgtcacaagtgctcaagcccttcacctctttcaagtaaatggcagttatcccaacgtccaaccaggccaagcactgtagcctcatgttacctctcctacccgttccctgatagctacttttccccctcctctgttccagccacattggcctctgctgtcctctgacaccccaggcatgctcctgccttgccctttgcacttgctcttccctctgcccagaacacaatctctctaaattgctcgtggcttactctcggagctccttcagactttcttcaaatgccagcttctcagtgaggccttcctggctgctgtccttgagctctccactgctctactctgctttatttttctccaaagtataatacttaccattatatgttatttattaattttatgttgtgtctgttttcccagaatatatgtattgcaagaagtcagggatttttgtctgttttactaaagattgtacccctagtacccagaacaatgtctggcacctaatagggactcaacaaaacttgctaaacatctattaacccaaaagttatttaatttattatatttaatggcaggtattgtattgagcagtagagtactatgtactgttaatcttgctaaaatatacttaaatatatcattttaatttagggagggggatatgacatcatttctgctctctcactagaattttaggtacatgatgatgtttaaacaaatttgcccaaaaaaaccaaattctatttcagagataaagccattgtttatacaattattatacttatagtagctatttttttaacttcaacttttctcttctgtctttcttgtttttgttttccagaaaagaggcacagttagatgaagaaggacagtttcttgtcagaataatatatgatgactccaaaacttatgatttggttgctgctgcaagcaaagtcctcagtaagttgaatgcaactttccttctttggccaagttacacgtagaagctcacagaatgcatggttcaagatcacaacgcagggttacagaagtggtgcagagcatttgtacaacctgcatagttgtgtggtgggcatccacatatcatgttaggctcaggctatgccaagtcttatttttccttttgcaaattctttagagaatagaaaagagtaaatgtgctcttcttgttgttttttgagacagggtctggctctgtcacccaggctgcactgcagtagtggcccaactccggctcactgcatcctctgcctgccaggctcaagtgatcctcccatctcagcctcccaagtaactgggactacaggcacgcaccaccacgcccagctaattttttgtatctttggtagagacgaggtttcatcatgttgtccaggttggtcttgaactcctgagctcaagtgatctacctggctcagcctccgaaagtgctgtgattgcaggtgtgagcctccacgccaggcccagtcctttgtctcccccaacagaaagccatgtattcaggaaggaaagagaattattgatacttaatgtaacaacatcagttgtggtgtcaagaaaacggtagttattcaagtataatatgtgtttctccaaatctcttttgtagtcacaagttatattaactattggtaaaagaaacatgaaactgagatctaccacagataaatatctttctgaagaaggcaaagttttaaaaatttcatggagaagaagttgttctcaaagtagtatctattattcccacagtgcttaatttttaactgggctatagtttggatacaatagaatgaagcttttagctttgccacatataactaggaaagcaaacactatctatagtagaataaaaattgttttaaaagattggtaaatgtttaatattaacaagaaaaatatctagcctccagcaatcaaaattgaaacaaacatgaaataactttttttattatcaatttggcagtcttaaaaatggaaatatctagtgtaatgatggagtacagttaatgggaaatcacatacattttaaatgtgatggtagttaagacaacttttttgagaacaattttgcctcatgaaagccttttaaaaaaatattaaaaccttcagtaatttttcctaaataaattattagatctctttccattaagatttatgtatgtgttttcatgtcagagttccatatattatcaaaaactgaaaaaaagcctacattttcaataagaagggattggttaaataaattattgcatccatatgttgaataagatagcaattaaaactgatacacagcactttgagaggccgaggtgggtggatcacttgaggccaagagttcgagaccatcctggccaacatggtgaaaccccctctctactaaaaatacaaaaattatccaggtgtggtggtgggttcctgtggtcccagctactcaggaggctgaggcaggagaatggcctgaacccgggaggtggaggttgcagcgagccgagatcctaccagtgcactacagcctgggcgacaaagtgagactctgtctcaaaaaactaaaaaaaatgtgatacagaaaatttaagttttaggaaatattaatgattgtttattaagaaaaaagcaggacaccagggtacatgttatatgtaatcaagttattaaatatacatatttatataaagacttttgtatcaaaatattgtcatgtgcattcttgatgattttaaaaatctgtgttttttggaaaaaagaagtagtatatcaaatatatgctttaaaatggccaaaattaagtacagggtgagtatctcttgtctaaaactcttgagaccagaagtgtttaggctttcagattttttttggattttggaatacttgcatatccataagaagatatcttgaggatgggattcaagtcgaaacataaaattcacttatgtttcatgtacaccttatagacataggctgaaggcaattttgcacaatattttaaatgattttctgcatgaaacaacattttgactgcaatccattacacgagttcaggtgtagaattttccacttgtagtgtcacgttggtgaccaaaaagtttcaggttcttgagtatttagaatttcagattttcagattaggtatgctccacttataatttgtaatagaagctgaaaaactggttgctttgcttgtaaatgcaaatgtacaccattaacatgtttatacgttgtcttctctgatttcattgtattgtcctggcgggatttttttcatatgatctatgcttgccatgcacaaaaattgaagacattttacattacttaataaacacttatcttcattttttctattaacaatatttcacctattatatgctttttttcccctcttgaatttgtaaaatagatctcaatgctggagaaatcctccaaatgtttgggaagatgtttttcgtcttttgccaagaatctggttatgatacaatcttgcgtgtcctgggctctaatgtcagagaatttctacaggtaagcaatttgaggtcctatagttaaaagttctgtgtttataactctcaaatatagactctagaatacttttgttcactcagctgtacaagagtgtcttgcttctgaaatggaatcgtagtcacctttttctaattcacataaaatcatcgttattggagcgtctcgaatacattttagcattatattttttctttaacttctggttgctgatactgaatatgcaagttgtaaattaatgttccctgaagaactccaggtggtcttttgtgatctgttcaactgccctttttttggggtaatggctctatatcctagtgattgtggttttatgtgttagacatttaatatggccttattttctatttacaaaacattcctagtttgtagatataatcgagcaatgtatcagtatttatgaagttctacctggagctcaatgtttaggaaaaagtagtagggttttcaggtgttctgtcaccaaaacatacttaagatccattatcattagttaaatattaattaatctactgtacgagggaaaataggaaacagtccaaagtcagtttcaggtgaaaaagttaaataatgcaatcacaggcctttgtcttacattcttgttaaaattaccttaaaagattgtactagtaaattacacattagatgagagactatttctggattgactatactattttaagcattgacatttgtgagaccctcttcttgaaatgtgttaacattgaaaattatatagttgtttgcaaaggatatttctaaactggctgctttcagcagccagatcttgctggaaaatgatgtcagtgcaatactagctgaaccgaagcccagttttgagggaatgtaaactactttcaatccagctgcattattgatttaacagccaaaataagaactttagtgtttaatcaaaatgtctgttgtttacatagtgacatttttcttataaacttaaaacagcattaaatcaagttggaaactggtttgcaatctcctgccatggatttactaaactactggtgtcaaaaaaagctgccacttccaaatgaagtagctgccaagagatatttaaataaaattgaacaggcagcatttaatgggattattttaaatggattaaaatttgatacttaaatgttttgggggattttgggtttttgaatacatatttcactttttagtacttttgttggccactatcaacttatagcaaagtttcaactttcagttgttctgacttataactctctctctcaatgcccatgtttacataacaaaacaaagattcaagtggttttattaattccttttttttttttttaacctctactcattgtgaccatctgctaagcttgttatggcacagtaagagagcaagcggccttttaggtgtgtttctctgtattccagagctgctttatccaataggacagccactagtgcatgaggctactcagcatttaaaatgagatgtgcaaactggggagtggctcacacctgtagtcccagctacttggaggctgagatgggaggatcacttgagcctgggagatggaggctgcagtgagtgagctgtgatcacatcactgcactccagcctgggtgacagagtgagaccctgtctctacatacatacatacatgtgtacatacatacatacacacaacaaagtgcaatgtgctgcaagtgtaaaatatacaccagatgtcaaagacagtacaaaaagaataaaagatggctcattcacaattttatattgattgatttcatgttaaaatgttaatattttggatatatttggttatataaaatgtagttaacatagctttaaattatacacaattttattttatttctctttcaacgtgagagtgaaaaatgaagaaactagaaagttagaatactgtagttttcatcaatattttacattatgattcagttcttttattttctcctggttttgaaattatacattttaagggcaaattgaatatgttaaaatactgcttttctaaaaagtagatatttatgttatcattaggctgattacacagaaattaaatggactttttctgtgtgactataaaacaaaatcattaactttcatacattgttttaacatgccagcacacatatattgacatttttattacgtaaattagtaaaatattctttatggtgacttcaactcttcactaaaaatttaaagactttctttctgtttcagtcctggttttaatcagtcacagcatctttagattctatttcccaaatactgagctttgggaattctgccacttttctctatttccccccacacttctttgggagagtctaccattatctagaggttgaatggattccctgcttctcttcatgactcctccaatctcttctccatcctataactctagtgctttttctgaaatgcaaatgtctctcgtcgtatcgttttcttgcttaaactctggagtaattttttattgctcactggaaactgtcaaaatatttaaaacaattgaaacctacatcctttctgcatctttcctctccctctcccccagtccagccaaacttaacctctttaagaaccttgtatttatcttgttcccgctatcctctcagcttttccactgctcttctctttgcctggagcatgtttccagcactttccccatagataaattctattaattctgcaggtaaaattacttctctgggaagacgccactcctctctccaagctctgccctatcctagtcacggtaactaacctctctcttattttcataggacactctatttccccagccacagtagttttcatactgcattatcattcccatttgatggactggaatgtaaacttcaggaagccagagatcatgtataatctcttaatgtttgtaccttcacagatgcaatctgtatatctgagaataaatgaatatcttttttaaaaaagtgaatatttgttgtttgtgcaaaagcagaaaacacacaataggaagcaaacacaccaatagatcaagctgaattatttgcctcaggataacccatttcgagtgagatcctgtaattttttttacggatgaatcatagattgaaatataaaagaagagacatacactagaccaatttccttttcaggtgaacatcctaaattactgtttattatttaatttacagggtacattgcttgtatctgttgacacttttaaaatggtcgttctgacatttccattttaagcttttagggaacactaaaatagctactgaaatcataacatgggagactatttgattatgccttagctgagcaactctgactcactcatcatagcaagcagaatttccttggaagttgcctgtccacagcctctcagttagatacattattaagaataggtctgtcttatatatgtatatacataccataccattgtttttacttttcttgaaataatgaaagaaaatttctaagtactagacacagcatataataggcaattaatgaaacagtctttaaataatagaattaattaattctgaagtatatgtgtctttataattatttggtccagcctgttttatcaggataatacctcttttgcttaaattttttattcgaggatactgtatagataatatctgtagcttagctccagaaaaatatttgttttctcacatggaggttatcatttccattcacagttgacttaacgaatactaacatatctttccccttgaaaggctttggtgccaatatccaattcatgaccctgcttatgcagtctctcctgtgcttacaaattcaagtttaaaaaatttgcattatgcgtattttaagccacactgagactttaacaaaaaaatagctagaagtcctaaatggataaataaaatataatgggatatatttaggataaataaaatttaggataaataatatttaggatatatttacgataaataaaatttatcctaaatggataaataaaatataaaatttaatggataataaaatataagaaatatttttagagaaaactttgtagaaatactcctcttctctaggcatttcacagtttagaattgattttttcttaaatcaccagtgaaagcatcaacttgtgggctgatgaaaaaagtaataatctttggcatttattctttggttgatttaataattgaaaatataatgtatcaaaaagagaaaaagaagacatttttaaaatttgatttttggatcttatatattttacctgggtatattgttttaaagacaagaccatatttcagtaagaattttgtctagtttttccacttttttattcataaattgacaataaaatgtgtggttccatgctattgctatagtcaatgtctttttttgcgttttttaatgttttattattattattattattgagacggagtcttgctctgtcgcccaggctggagtgcagtggcgcagtctcggctcactgcaaactccgcctcccgggttcacgccattctactgcctcagccgcccgagtagctgggactacaggcgcccgccaccacacccagctgatttctttttcttttattttgtattttttagtagagagggggtttcaccgtgttagccagaatggtctcgatctcctgacctcgtgatccgcccgcctcggcctcccaaagtgctgggattacaggcatgggccagagcgcctggctgctatagtcaatttctatctgaagcttctagtgtactgatgaaaagactgcaaagaatacatgggatttgaaagcttcataagaaaatagctgataaggaatgttcagtttaatgttatttctaccttaatccacgctcacctctactctctaatgtcctattgcattatggcacattctattttccctaaattactgcaacagtctctcccatctcacatgcatttctgtagtatgattttgcctcttccttgcgggaggtaaaattctcttttccttgaatctgggttggctttagtgactatttaaccaatcgaatggggcagaagtgagatatttaaacttcctaggctagagtacaggaagtcttggtttccttcagggtatcttggaacagttgctgttgcgatggtacctctagaaacccagacacatgaaatgagaagcacaagccacatggagaggccacgtgtagactggcagatagcagttctagctgggctctcagcaaagagctggaaataactaccagccatttgattgatccatcttggaaaaccagcctgctccggcattctgataatttcagcccagtttccatctgattccgtcccaagggtagaactttctaatttagccagacaacccacagaaccatgaaaaataacaaataaattattaaagttgtttgacatacagctatggataactagaccactactctgtgcattatttttccctttatattttatgtctgtgttaatatgtgtgtatatgcttgtacaatgagtcaagagctttgagaaagctgtatttgataagataatctattacccctgggaataggagccatgtcagtcccaaacagggctaccaattcaatttcgatggtattacattattattacattatattgtttttacctcccctacaaatttacagagttaaaatgcaattaaaatgagcagcgaaggctgccaggttgactatgaaaatatacgtgggcaaatgcaattttagagaacagttaggatttaaattatgacctaatttaaattagaactcaggtgaatagttagatcagcgttctttcattatttgctggagacactggcttcttcaactaaccttgatatgttgacagtttcagtcattcactcaactcagatatatttgagtttatcaactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacaacgccaatttctataatccaataataaaaatagttttattttttaaaaacttatgaaggaagataagaagtattccagaattgtaaggcttttcagtttgaataactggtatatattttcataatttttcaaaatattgattaattgttacatgtagtattatatagactggatcttttttaacatgagtttaaaagcaatagaataagagaaatattttaactgtttttctttaattaaaatatttccttggagaggatggtaatgataaattgatatagctttaacgctatttccatttaaataattttagtgactctggtacagtttctttttaaatagagattttcaatgtttcttttagaaaagaatctctatatcttttcagttgaaaagctatttaattctcaagaagcagctccaggaagaaaaggcaggaaaagtattatgaaagcattcacttcctactccaatctcatgctatttactttggtgtttctcatcatctagggtttgatgttccattttacttaggtcgactttgtttaaatgttttatcttcaaattccaaaatgacttttttcttataaaacttaacaaaatattttttaaattacatgactctcattaaagaatgttggtgttggtcctatttttcagaggtgtgagggatagaaagaaaggaaatactatacctcatcctccttcattgaaaaacaaaaagaggtttgcaatgactggttttaaagatttcttgcagatctaaactgcagtaatattctcaacacagacaactcccttctccccatccactaaaacaaggattcttggatactgaaaatgtttttctttaaaacgttcaaggcaaggtcttacccatttctgtggatcctttaaaaaatttaattagatgtccttgaaacaggaaaatcaggtagttgacttctggggactttgcccctgtaattatgtaagaacttatttttggcatgcatattacaaaaagaaaatgtgcatttattttgaaacatcccaagatctttaaaaatgtgacactttattactcaaaggaatgataaattgtcttttgttttctaaatctgtgaagtgtactatgtctgaaattccagtagagtaccccagaataccagaactaatttttcttttataaatgataaatgcaaggtgataaaataaactagactgacagggagcagaattcctgagtagaaaaaccacattcatttgcttgtagaaaaacaataaaatgatattagaacattaagaaatgaaattattaaattaaaacctttaggtatctcaagatatcaaaatagatgaatggacctactctctatatttttcctgttttttgattttatgaagcctagaagaatgaatcaaagcatatttcagatttacatcattgtttcctgggaatctacttgtgctgcaatgtaagagtttacattttttcagtgtcttttttactttcatacatatggacatacttctttgcaattggccacacagctctttactttctgtaagtgcttctgtgggtatatttagaaataacacagaatatcagttttgatatgaaactcttattccccagaatacattgttagagcaatgtggatgaactatcatctttgtttagatagcattatcaaatgtagaaagggttttctcttggccattgtaagaatctttttgtagcaaaaaaaaaaaattgtagcctgtatatgaggatgacacatttattagcaatataagtgtacttaaatgaaaataacttttaatcattaatctcatttcttgtaatagtctggctgtggtaattactttaaattttgaaagagtaaagccaagtaaggaaggttgtaactcaagaaatcccaagagtattttttatattagatactatctaaagaaaatcaatattacattaagtggtgttcaatcttttatgattcaggagagcactttacttgttcaattaactaatagtaaattcaataacacagtaaatctctggagagttggttactgcaaaaagacagaaaaggtgaacattctcatttggtgtttttggtatcctttggtgagggtgcagtgcctatctttagtgactcaggaagtactgacttggatgattgtgtccactctctgacttgccccagcataagtggtgccagtgacataagtggtgcaagtcgttattgccttatgccatctgcttgagtgaaagtagaaatgttttaataatccagtaaaaaagatgagtatgaaaatgatataagcacattggtacattgatttatgaaatatgtaagcattctgtatagaaaaaatattaaaatgcctttttgaagttattgtttggttcaatttccttttttttttttttttttttgaggcagaatctcactgtgtcgcccaggctggagtgcagtggtgagatctgggctcactgcaacctccacctcctgggttcaagcgattctcatgcctcagcctcccaagtagctgggactacaggcatgccccaccacgcctggctaatttttgtattttctttctttcttttttttttttttttttttttttttgagatggagtctcactctgtcgcccaggctggagtgcagtggcgagatttcggctcactgcaagctccacctcccgggttcatgccattctcctgcctcagcctcctgagtggctgggattacaggcacccaccgccacaccctgctaatttctttttttttctcttagtagagacggggtttcaccgtgttagccaggatggtcttgatctcctgaccttgtgatccgcccgccttggcctcccaaagtgctgggattacaggtgtgaggcaccgcgcctggccaatttttgtattttcagtagatgtggggtttcaccatgttggccaggctggttctcgaactcctgacctcaagtaatctgcctgcctccgcctcccaaagtgctgggattacaggtgtgagagcacgcctggcctcaatttcttttttaagtgagccaacaacacagtacctgggcctgactctattagaaacattttctaaatgcagccacaagctcaattttgactttgtgagaaatgcagataaaaataaaactctctcagtgattttttttttctcacccgattttctttcacaaaatgtttcacaacataagtagaagtataaggggtctgagagggctatgaagcagttctcaggtcgtcccttctaagggaagagtcctaatgagaatgattcatcattggaagaacctctcatactattcaaccaagtaaaacagttttaggactccggggtttgtaggttatatatacctcttcaatacttagtggctgccatattggattacttttacatggcaatagcagcctctagaggcaatccggatgaactgatgtttttgctaagaattagcttgactccatcaggtataattgtggggaaggaaacagtagatgcagacggttcaaaaagtcaccagatttatcgagttgaggaggtcattgaatcatttatctggattagattgtcaaacttcatgacctagctcaaatcacatcttcagtttgaagtatttttaactccattctttcagtctgaattgttggcttcctcatttgctcatcaaaagccactctacacatccatttgtgatataaaccatgagctgcttaatcctcatcatgcagatctgcatccaaacatctaccctgcacccaagcccacatgacacagtgtatgatatataatgcacatacaataacattatagagtgaatgcatgattgagtggatgtgtggaagggacagaaaattaatgctgtaagtgtcctgttagagtattgctcaaatgtggacacccgcggaatcatctcattctcaccgtagtttcctcccagtaatctcactggatttttctgtttttctaaattgacctctttgagacatttggaatgaaagccatagtttaattttggcatatctccagtactttcattttaggtatgttcttttatgcccatgacattttgaaactgttttgttgtttttcttttcttctctttaaaaataatcaccagttgtgaatagattactacttgcttggtgtatttgttttttattgctaccataacaaatgaccacaaacttaagtgcttaacacaaatttattaccctatggtttcataagttggaagtccattgcaggtcttactggactatattcagcgtgctgtgctggtgggacgggactgtgtttctttatgttggcttttggggataattgttttcttcctcattcaagtattgacagaattcagttccatgcagttatagggctgaggacccagtttccttgactgtcagcaggcagctgccctaaagtcctggagacctctctccagtccttcaacagtctcctacatctcagaaccagtcgcatggtgttgaatccttctcatactcccatctctttgaccttttgtcattgcacatctctctgtcaccatgtagcagggaaagcttcttgacttttaagtgcacagtcacccatgtgactaggttgggctcacctggataatccaggataatcttcccaactcaaggtccataaccctcatcacatctgcaaaatccctttcaccatgcgatacaacatattcacagggattaaggcaagggaatctttcagagacagttgttttttcagcctcgtctgaaatgtgctaagtgctttatatacatgtttaaagttatctccattttgccagaagaaataaagtcttagaaaaattgggcgaattggctaccttcctatgaaatgacagtcattatttaaacccatgtctacttgatcctaagtcatattgctcttaattcctataccatgctgtgctgtgtgtatatcctactatatatgtgcagcacacacacacacaccccaacatgttatgaactgagtgttatttgaaaaatcatcttgggccacataaaatgtatagcttacaccgtttcttctagtactctttacaccaattagttttgtatattagtaatctgagactcagggaaacgtggcatcttccaaactaatggcaaggctacaaaaacagaaaatatttattggccaatttattagttttcctagactttcaaaatgtagttatttcacagattagctatgaaactccaccttgatgatagcatactaaagaacatgaagaaattacattgttttagtttctaaaatagatttttaatttctaagatattagaatagttaaatagaaatcacaaaataatatgcttatgttttatatgcttataatttgggcatagttttttgagttgacaattaagttttagaattgcagtataaacagaagggaaatgtgtgagtcctttggccattccctgttgttgatcacaacacgtagaaacagctgccccaagctcttgtaaatgtatctttgccttagcccttaactatgtttttttctgttttagccatcctttttaatcccacttgtttatcttttcttaaaatgtactaactattcatagctgcagatatttttcttaattctactatcttagtttcattttctctgtggcacttgctttacagatatctcagtggagtgaaggatgtgctacatgtgctgcttcgctgatctgcccactagactccgatttgactcgttttcatatcttgctttcccagagtctgctgtcattgcgaaagcattgtttattggtctccctttcttctttgctgcagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggtaacaaacagcaatggagacttctgaacacagatgacatctaaaaatattttaaatgacactctctaaatttacctgcagttatcactgttagtgctcttccctggaagtatatataagccaaaacagtggaaagaccagcaatcttctatatttggcctgggagtgcattatacaggatatttttttccttctggcagcagatttttctttctaattatatagtgttcaaggctacaagaaatttactttgcattccctgtgaacacacaccagctgggaagcagaaggatatgtgacgactgagctgtgggtttcagcatgcaaaatatccataatatggatagtcaaattctaaggcaatataaaattaagtattattttatagatcattttctctttgtcgatttttgtctgccccgaaatatagttggaatgtctaattttgtgaatgaaagtgtttgtttttgtttttgtttttaatcaagttacttggtgaaagaagccaggtctggtactttaaaaattgtgctgttattgataatacacactcttagttttgagtgatgatttcaaggtactgatagggcaaccgtacaacaaagagaaccactgtttctctttacctctggcccttacggtttctcccagtcaggctgctttttatgtgttcagcatgttcatacccaagagtcaattctcagtagctttaaacttgaggccaaagtggggagatagatacctttttccaacctttctttgtttatagaaaacctattagacagttctttcttatagatcatagatatattgtaacacacttgggaggtctaaaacccttaagtggagtattatccaaaattaaaatagtaacatttaaataaattagaaagatattccacatatttaatctagtaaagttatgttagagttcatggttttctttctttcagaagttggtgttagttcttacgtggcaccttttggtgatttccaggtgcatcgttagttttctacaaccattagtaatggcggaaaccacgattactgttgcaccaacctaatagaaagtaggactgtgtataacatggcattatcaaatgcagacatttaaaaattaaagccttgggtaaagtatcacaattcatccatgattgggaatctcactggtattcaatcaaaatagtatatacctcacatttccaatctttttttttttttgagacagagtctcactctgtctcccaggctggagtgcagtggcgcgatctccgctcactgcaagctccacctcccgggttcacgccattctcctgcctcagcctcccaagtagctgggactacaggcccccaccaccacgcccggctaatttttttgtatttttagtagagacggggtttcaccgtgttagccaggatggtctctctctcctgacctcatgatccgcccggctcggccttccaaagtgctgggattacaggcgtgagccaccgcgcccggccagtcttttgttcttgacattaaactaacagtatcgcctgggcgcagtggctcacgcctgtaatcctagcactttgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagagaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcgtagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttgcattttataggtatattttatgtgtttaattttttcaaaagcactgttttgacttctcgagggattctcacattaagtttatcaggtccagagataccagacaatttgaaccacatggttaatactagatcatgtcataaagtgatataccaatgagaagttaaaaatatgattagaaaagctatttgttttgccagtttgatcaaagcaaaaaaattagaattgaataattaattcataagtttaggatacatataattcaatttctctagttaaatagaaacagagtagaacatcaaaagtaggcctgtcatttaaggttgactctcttgccttgtctatgagttagggaaatcaaccttaatgtggtaaaattttcaaattataaataaggatactaatatttaaccagtatagtaagttattctgacagtgaggtagtaacatcccagttttgctacaaaatatatctaaaagaatatatacaatagcatctatagttattgtgatttgtttttaaaaattgcagagaatgcgacagggtactcctgaaaaaaaaaaaagaaaagaaaaatgaacaacattttgtttttatttagctgtaactgaagaaatgttgtcccaaactttttctgttttgggtctggttgccgttgagatcgagttttccctttgtaagagggctcattgcttgcaatttcttaacccaaaaagaagaggaaaatctatactttaataatgtatttgcctgtgaataatactttagaaaagtaggatttttttacattatagatattagctcacaattacgattacttctttagaatgaattcctagatttgcaattaaatcaaagaatccacaaaattttaaggaatttttatgcctattgtcaatttatccttcagaaagattaatcaaaataccccctcatcagtggtatttgagatgcctctttttcagtaccttacccaatttaatattgtaacttttttttctttttttgagacagagtctcgttctgtcgcccaggctggaatgcaatggcatgatctcgtctcactacaacctctgcctccccaggttcaagcaattctactgcctcagcttcccgagtagctgggattataggcacccaccactgcgcctggctaatttttgtatttttagtagagatggggttttgccatgttggccaggctggtttcaaactcctgacctcaggtgacctgtccgccccaccctcccaaagtgctaggattacaggcgtgagccactgcacctggcctggtattgtaactttatgtatttgatagttgatggttaaaaatgacattgcatttatttttgaatatgaatctctatcattttatttcccattgttttaaaatagtattgtaatcttatttgatagtgctagcttgcttttagctggctttcaggttgttcactatacaagtgtgcttggctaagaaggcagagcccacaagtgctttttttttctaattctaccaaagagaccatataggatactggggaactgataccagatttgtaattttacaatgattattcaatcttcaaattttatagatcaaagtccagaaatattttcctattttagacatatggagtatttgcatatatgttttgaatttttgtaattaatcttctaaatgcagtattcataactcattttttatatttaggtatttttattaaactgaaatgaagacaattcatgccatttccccctttgatatccaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccaggtaaaatgacagcatacttccttggggcctgagacaaaagcccatagaaatactattgttacaggcagccatccattcatttaaccctctgactatgtattaggtaatatgcagtttattgtaagttacacaaattgtttaattgtgaactaagtgtatttgagcataccacaactttccctaggacaactatttttttataataatcacatacagaaacagtaggaatgttatgtaagaatagtatacttgttacagtgaaaaaaaatgggtaactttttagtaacagtcacctttcacatgtttatttattcactgaataaatattcattggatatctaccatctgtaaatagctttaaaaatcaactattgatggtgttaagggaaaaggggggattttaaaaagaactaaaacacaaaatgatagagatgatgatggattcagtagaaaaagcatcaaaggaagcagttgggatgatgatgagaaactgctgttgacttctatgacagatccattggtaaaatcctttatgcttactctttttttcttaaatactaacttttggagttgtatatggcatacgtttagagatactttttgcttgtaattaaagagacttgaaaattcaggattagcccagttggatcaggtgaaatggaagcagagtagtgtgctgtcctggctctggtattgactctacctgtcccttactgtatgaccttgaacttattacttcacttctctcagcctgtttctctttgttctggcatgagaatagaaagcatatgaaaaatacttagttcattgtaagcaatcaatcagtgttacctattgttttcacttttagccctctagataaatattaagagagggtttgctcatgtttttggtattttaatttcatttcaagccatacacatttaacataacactgtacattttaaaagataaattttcattttttctccttctgaaaatgcattgtaaatttatgctagcttacatttgaatattagtcatctgaatccatatcagatttcatgttcttgtaactatttaatgtccatttaatcactgagttgtatagattgagatttgagttgatagttcagctaagtttcccttgaattataataattataattttctagttttaaatataactgagctgatttaatcaagcgattaatatcaaagtataaaaactattttaactgatgtgatactctttgctctctatctatattttagctccagcctgggaattgcagccttctgtctgtcttctcgctggttcgtcctcatattgatattagtttccatgggatcctttctcacatcaatactgtttttgtattgagaagcaaggtaatcaagatattatttcattaaatgtgagaaaggtatgtcacaaattagaagtattcaggggggaaaattatcacattctctgagaaagtatagagagataaaacccagacctcaaaggaagatctatttaaaaggcaataacattgatttttggtttgcctgaggagcagtggaactctatcaactgattaaaattaacagaggtaaattttagagactgtctttctgagacggccttgtttcacatcaaaaaaccaacatcttttactccctgtacagctacagtgccttattttagaaatcagaactaaaaaggatttttttttttggaacttcactcaaaaccacttatttattctttcttaaattgtctattgttcttagtagcgtttttgtgggtgaataaaagtgatgaaatattcacacagttgataatttagatagtgctgggatctcacggtttctgttcttgggatagatacagcaaaagtcattttcctagagtacccattgaatcctttctgtatttggaactgactgtttgcagctgctctatgaatacagggtgggagaatggggaggcttggcttattctttgagagtctggtaatgtatgttggaaccataccggaaaatcagggggataaaaaagattcacaaaagcttgaaataattatgtgaagagtagcacagttactgtcctgaattcagacgggacagtcacttttctgcagtgttgcaaggcagccactaggcttattacaggcagaactctgacagaaggccctctcctgttctaatgatgcacttattctgctttgtggtttggtgggaaatgagatatgcgtgtccttgttgctgaattcttaggtagggagaaaggcattcattaatggttgtatcttgccttttcaaggaaggattgttggatgtggagaaattagaatgtgaggatgaactgactgggactgagatcagctgcttacgtctcaagggtcaaatgatctacttacctgaagcagatagcatactttttctatgttcaccaaggtaatcatttttagattaattatagtggctatcagtacctatctttagctaacaaaggaatgccacaatattttattccattaaatttacatattctctgaggtgtaattagattttacagcccttgttgtgtattactttataacaaggataatcttatttaatatttgctaataaactcagaagaaatcacatactctatgttatttgccatgtcttaatacatttgtggagtgtttatgccattacgccatgggacaaataatctgcattaagctaattctatagttttggaccttcaaaataggcattatgtagaaaagtgattttttaaagcagctaataggatggcataataaatacattggtatatttgacatcaaaaattatcttttctatagtatgttagcaaaaaatctaaaaggtctctttctgggtttgaactattttaaattaaaaatatttacctactctaatccaaatacactgttccaaatatattattcaattaaaatgtatgtaaaatgtgatttttaataaacgtcagagaaaaataaaactatagattgttgttttccaatttaggaaagcattttactaggagatacatgggaattcagaaatataaaaattatgtctaaatttgcttcagaacaatagaaaagataactgtggggattattgtgagatgatattctgtgtattcataattttgtataaacaaagtgtaggtgcattatgtagtaacacagtcaagaaggcatgttttggtgagctattggttaaaaatttaatctgaattccaccatgatcacttttcacttaaaaatgtggtcttaaaatttctgaaaaatgtaatacactttgtaacaacctcctgttatattattactattgtattatacattacataacaataatatataaggccaaataagaataatatattgttggcacagtagttcacacctgtaatcccagcactttcggaggccgaggtgggtggatcacaaggtcaggagttcaagatcagcctggcaaacatggtgaaatcccatctctactaaaaatacaaaaattagccaggagtggtggtgggcacctgtaattgcagctactagggaggctgaggcaggagagtcgcttgaacctgggaggcagaggttgcagtgagccgagatcatgccactgcactcctgggcaacagagcaagacactgtctcaaaataataataataataataataataatatatcgttaatttttaagtacatttaagattaattaaatattatttaactatgacatataagaataatatatcagataatataaggatatggatgtcttttccctgagaaataaatatcaggaaaataaaagaaacaaaactaagaaacataaacgctttttaaaaaaattattaagctacattgatctaaagatgtcccatctgctatcagtaagtgttttcttcttctgcctcttcacaggttgagcttaggagaatgtcagcttctcattaggggcaatttctatttatggaaagaaaggttttcttcagaaataaaagcagaaaatttggagtttatttgttaattcccatatgcagacattggtcacccagtgagaaaattgcagattgtcctatgagacatgctcaggtgtgtaggaagatttgtactcacactacataaacaaagatcaagtaaaagtagttttacttgtaaaataattctaagatgattagtttgaatttagaaaaaacttaatggttcattaaaataatgatatagggcatttttagaaccacgagaccgttatgatttaagttttgtaactcagtatgagcatttttgaccattcatttttgaacgtacaatcatgttttttctctgctcatgggcaggtctcgtatacctttggccgatgatctggcttctttctagatgtgtctttttctgcaagtggatttacatatccattttaacgaaattaaaagacaccgtgtatttcattagtaaaatctttgattgttttattttctttataggtatgctaatttttgttttgctttatgaacattgctgctgagaatatattgcattaatccaaaattctgcaaagtcaccccttttaaagaattttggataggattaattcaaaattcttcaaattattaatcccagattctccaaagacataactaaattttttccttttagagtaattattattcagagtggccagaagtaatgactttgcattaaaaaaattcaagccaaagatataaccttatgccattttaaccagttaggttttgttgtcgttgttgttgttgtttgagatggagtctcgctctgtcacccagactggaatgcagtggcatgatctcagctcactgcagcctcctgctcccgggttcaagcaattctcctgcctcagcctcccgagtagctgggactacaggcgctagccaccacacccagctcatttttgtatttttggtagagacgcgtttcaccatgttagccaggctgatcttgaactcctggcctcaagtggtctgcccacctcgcctcccaaagtcctaggattacagatgtgagccactgtgcccagcctcaaagagtacatttttaaaaagcagttaactttttacttgtcagattatcactaaaataataaacattattatgttgttggaaaaatgacacaagttacaatgatgacgcataaaattcagcaggattgaataatgtttcaaataaatgagaaaaatttgtcaaagtaaaaagaagacatgagagccagaagtaagaatgacacatagttttagatacataaattacatgctgaggctgggtcataaacgtggttgggaatttttactcattgtttccaaaagggaaaaataagcagttacaagattcatagaatacagaaagcaaaatgaaagtttctcaaaagaagcattattattcttgagagagagaataaagatagatttttttcctctccttatgatgagaaaaaatttgagaataataaattacagcctgtgttaaatacctcaacgtttatcatagagatgttttctacatgatcgtttcaatttagactgatggcaccaaaaagtgcaacctggcaaaaatgcatctcaagttcactgctttttggtagatgcttaaatatctaagagaataaactcacaatcttcgttcaattctccataattctattgtcttcagcctgatgttttgaatggtaggaggtggcaggatcagattccttgacagaaatcgggattgcattgtcatgtatataagttgagactgatcttgcctcatttctccatatgacagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacgtaagaatgtaacgcttggagcactactgttattcataacataatgtgactctactatatttaagtttgagaaccagactaaaaagccatgtgacctgtaatagctctggtgtagtaaataaaatctttcacattgcttttaaaaagaaattatgcttaaggaaataaaccagtcttaatggtggtggaaatatgtctgctatttttagaagccaagttggaataatataggccaaaatatcttttggaaaatcatgagaataactcaaattcaaatttagttcaaaaattgaagtttaactatcatttattcctgcattctttcatacaagagttatatattgaccatcttcagtatgctgggggctgccgcgtgcagagagctgctctgcacaatgaacttaaccactggccattacatgtttaaaaatttattttctgggaccttgaatttaggattagaaagaaatgaatctgacaaattgtaatattatatgtaatgacaacaattacatctatagtgacatacattagcaaaaatatcaaaatataaaacatttctatgagtggtggattcaattatgaaatattgagcaaggacatgaaagataatacttgattttcaagaaatgtatttaagtaagtacatagcatgcatactacttggccttgctttcatatgctaattaaacgcacatcactgacatttataagctattttacccaggttcttatgtgttcgttttttaatgtttatataaacatttggcggagcttctaagaccttaggactaacgttcaaagtcacatgggtttgtaggtttgagttactcaatattctgttctggctgtttgtattagaaaatcatctaggtttcattttttttgtattgtgactcaatttgctaatatctacattcatgataaatagataaataaccagcactataaataacatagcctttaaattatgacatatgcagatattctgtactgaaaaagctcttaattcacttcttttcctaaattgtcagcttaagcagagtattagcttctcttcctagaccaggagtccaaaactgggagttgctgggagttaaacagcggccttgtctttaatacgagtagctgataagtacttattacagaactacttctttgtttggattccccaaggtgggtttcacattcaggaactatttgcaccatttcgagttactgtgcttcaaaaatccttatattattttttagattattagatttagaatttggtttttgtagatatttgggtttcaaggtgatgtcattagaaaccatttactattaattttctttaaagctaagtagttttactgttcatacttactattcaaatatagctttaatatttcataaaacattcaatgtttaaaagttgaaaatgaaagaccggagaaattctactatgactaggaaaaacattgagagctcagctccattttgcatatttaaacttcccacatatgcccttttgctttagagcaaaaggcaggaagaaaaaggcaggaaggcttcatttgttcctcttcagtcttccaatccagagcccataggtctagtttctgcttctttccctctaaattcaccagctgtcatcctcctcctgtgtgctcacatttgtcccttagcatgatcccatagtagtctcagttgtacctaaagaaatacaataatttattttctagaccaacttcctctggttttatcagtttcttctatggaggagtgaggcatgaatgagactggagagaaattctgcttcttttaatattacttaccaaaaatagagacatatttcttattctaagaggcaaacctgtttccattattgtgctattcataccatgttttaggtgctggtaatgacagtcttcatactgtgactatcgtaatagcagggtcagaatacaggactacaaatgaaaactttgattttctattaccagtctttttgttttgtctgtttgcttggcttattttgatttggtttgaactagtttgggcttgcggatgtcttatgtgattaggatgaacaaataatttatgttttctgtaaatccttgcttataaatacagctaatatttgatgctaattttagaggatgtcctgctagaatccaggcctttaaagtacaaacgacactgatgctgtgtgaaaaggacagcagaagcactaaaggctttcccagtatttcttacagtggctttctgctgatcccactgaacagattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggcaagtgttctttatcgctgactgcagagctatccagaggctggcgttctgagactcccctccagaggccatgtcatcacagctctctgactccagcactgcagccttgagtacagtgagcctccatgtattcactctttaccatgttcttaaataattgcctcttgttataaaactgtctcttccttgtaaccacaatgaatgtttcatgaagtgggtgattccctggttaaaatgaaatgttcaccatcttatttgcacttaggctaacaaatctggacaggctgtttatcacatgtagtataaacatagcattcattttagtcctctgcaagagacatttttactgagatatataaatgctttgtacagtaaagaagtcatgaagcatgagaaggactcagatttgcgtttagataacatcaacttgaagaagataaacatttataaggcgtttttgccctttgtttcatttagaaataaatataatattggaaaaaagaagtcagtggaatattgctacataaaggcaagaatgttaagtaaaccatctctagatatctggggtaatataactacacaaggactatttattttatagtcattttctgaggtacactctagcatgtggtgagcacatcatacaaacaaatgattaatgaccgtgataaatcactgaacttgaaatggtggctctccatgccgtcaagccatcactgttttaggtagaaatgtaaaaaattattcttctgaattataaagttatctgaggtgagaaattaattgcttactaaaggaaaaataattctatgtctgtacctgcccgtcatcaaagaccccaagtgtccatcatgtgtgtaaattataagtaattgcaaggtttcattttgttggagttgaatatattagaattttaagagaattaaagggggagggaagcttaaagttgctggtagacttgaaaaaatatgttttttgttagggtaataaatgaaacagtcttttttatgctaaccgtgaacatctaaatatatgtactgttaggtggagactgttggtgacaagtatatgacagtgagtggtttaccagagccatgcattcaccatgcacgatccatctgccacctggccttggacatgatggaaattgctggccaggttcaagtagatggtgaatctgttcaggttagtaaatgaagtagatattgtaataatggtatgtaaacctttttggacaattgattcatatcgttgtccggaaaatcattaacgtgtataaagaagggcatcttgacaacaaagactatagcatttcatccagcccactgtactacattctttcatagacatggagatttatctacctgtttgaaattatctagtccgtttcatgtactgaaagtcatggggatgagaaaaaaacctcttgtaccttctagtttattttttaaaacctctttcatgtctcatgtaagttactagattcacatctttgaaatcttcagacttcaaatgtttctcttgagataggatatttccctggggagatagagatttcatggagggcttttgaagttgtccataatatgcttgaaattcttatagacatctcttacgatgttatatgatgactctacattattctgtaatataaagtaagcaaaaattcatgtgttacaggaacagaaaaccaaacaccacatgttctcactcataagttggagctgaacaatgagaacacatggacacaaggaggggaacatcacacaccgggacctgttgggagtttgggggcaaggggagggagagcattaggacaaatacctaatacgtgcggggcttaaaacctagataatgggttgataggtgcagcaaaccaccatggcacatatatacctatgtaacaaacctgcaccttctgcacctgtatgccagaacttaaagtaaaataaaaaaaaaaaaattcatgtgttagtgatcaaaatgattgaagcaaagctttcttttttgcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacaggtgagagaaaatgtcttggtatttactgatttgcaaagaaaatgtgtctttgcatgtggtttaattctctgagagattttgttgctttaacagagttatcaccttcactcttccccactgcttgtagagttgtttactttttatttgagaagattgtgtcattatttccattttatatgatttcacatcatcttaggaaatcctgatatgatcattgtttctaaagctttgagttacctttcagtacaacttcagcatttgttcttgccatcttggtttataacatgatacatgtcaccttctctataaaacttgtgtatacttctctctctactccccttcccttgtcttttagatgtcttatgtctccagaaaattcagatccacaattccacttggagcacagaggcccagtgtccatgaagggcaaaaaagaaccaatgcaagtttggtttctatccagaaaaaatacaggaacagaggtatgactaatcaaagtgtaatttgcgtacttaagacagagtataagtatggaaaactaaagcaaaatcactgaaaatgtatttcatttgaaaagaattcttgctaacagaaattaacttctaagtaaagcagtggaaataattgaacattaatgagccaattacaatcataagtactttttaggggatactttagtgatttttgtcctctaatgaaatgaaaaccaacagactggattgagaaggctgctttttttcttgctgttgtggttgttttgctcttcctctgtagtctggctcaaaggtaagtgggctgtgaggggctcccctgacccctttcctcagctctctaagttggctctgagatcaccacagataagggctgtggttcatgggaggtttcttaaccatgaagcttaagatccttttaaggggcaggctatctttctatggagtgattggggaattttggaaatcctagtccctcatgtgtttctcctagatagatgagtgatttttaacttgctagaatctgattaattccttagggaagatttaagttctttctactactatggttatactccaggcagagcccatgtgctagaatggacttcagaacagtggcacatccaaagtggaatcacacctctcatagaggccttgcacacactaagatcatggctagcctcttcctagccttttgtaaggagtggcatcagaagcaagtttgatactttgttaccctgttgatgtgttgtttcctcatgggggataagactgcatgctcatatttctcttttagtgtgtataaactctctaaagatgcttttagggcataacaacttctaaagggaatagaatgccagggtttgaaatatttatcttctttcacctggtttaacattaaatcattttcctatgaggtggacatgcttattgatgttcttctgataaactaagccgtaattacctcaaacattggtcatcttagtcgtgcggtcctgtttttcccagaattatggtgggaatgatttacagaaactgtagatgtgaacgtggatcacactctcataaagagaaaaatatatttaattgatattataaacctcactatcactgtaaatcaatccctcttttcttctgcctatttaaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtctctatacagtttttatttcaataaaaatattaacattatttttcatttt

SEQ ID NO: 146 - DNA, 930229 bp, Homo sapiens
atgtggggagctttccttctctatgtttccatgaagatgggaggtgagtctcaatctaatagtaaatgctgctaggaattttcaaaacaatttcctttcagctaaattattgcaaattttgacatttgtaatgagagtatttcctgaatatgcattttcctaacgtggtgctaattgtcctcctgttactattgctgctgctgttactgcaaccatttatttcagtctaagaaattctcccatcaatggcagttcttttgtgaccacatggaagcatcatttaaaaaattattccaatagtttttggaggaaacatcatttttaataatgatggggcttctgggggtgctgccctagtaacaatcatgtatcttgtcataggcactgcaggacaaagccttgagcagccctctgaagtgacagctgtggaaggagccattgtccagataaactgcacgtaccagacatctgggttttatgggctgtcctggtaccagcaacatgatggcggagcacccacatttctttcttacaatgctctggatggtttggaggagacaggtcgtttttcttcattccttagtcgctctgatagttatggttacctccttctacaggagctccagatgaaagactctgcctcttacttctgcgctgtgagagacacagtgactatgaggcctccttaactgtgccaaaattcaaaagacaatcagtggagtacaggtgggcttgagaagttctagaacttcctgagtgtatctttgcttaccgtctaattttaaacttgtttagaatatgtagcatagggctctgagacggaaccccattattttctgaaccattgattgctaaagagaaggataaactattttctctctctctttcttctttagtttcttcttttcctcttcctcctgcttatttatgcctccagtatcctgtggttccacgtatggaagatggaatttacttttggaggaagctttttatacaagggaaggatcccttggtgagtgctttagtttatgcagtagtaagttacattaatattcatgtatccttgggaggctctgaaatttgtgaagtaaatgcaaattcctcagcttgagatagtatgatttcatttaattatgtcaaatatatcctcatttttgtatttacctgagtgataatgttgatattatttagcattttttggtggatttatccaacatattggagagtgtgggggctgtggacttagagggtgaagagaagatcatggagagctcttctctgtgaaacagaagagtgaggtcatgcgatgaggtgggggtcaagtgtggaaggaattggtcagtagggaattcctgtaaaagcactggataatggacagaacagtaatataaaatattcagtttaaagattttcttttactgaattgtaatttttgtgtgctatcctaaatgtttttgaagtttgttaaacattacagcctacatagtttgtccttagagggcaatgcagaatttcttccccataggtgaattattttttggcttagtacatttatgtatgtatgtatgtatgtatgtatgtatgtatgtatgtatgtatgatggagtctcgctctgtcacccaggctggagtgcagtggcccaatctcggctcactgcaagctccgcctcctggattcacgccattctcctgcctcagcctcctgagtagctgggcctacaggcatcggccaccacgcctggctaattttttctatttttagtagaaagggagttttaccgtattagccaggatggtcttggtctcctgacctcatgatccaccagcctcggcctcccaaagtgctgggattacaggcgtgagccactgcgccgacctctattagctaatttttaatgacttattttggggtaaacagaataagagggacttggtggtagggagtagaaaggtagagtggatggttttcactcaacaaatattttactgaatacttatatgtgctaggcactctttcaattgctatggtgcatcactaaataaaacatacctgcactgaggttgcttatgttcttgtgaagagagagagtaagtagatgttttagcagactttgaaagcacagggaaaatacatttgaccctcagaactcagcttcattttctttaataggaagagagctgagatgtatgtaagcaatgctgatgtcctgtgcttgttataattttataatataaattaatcatcagctgaataagggctgtataacattggatagttataagactgcaagtcaagttatccaaagaatctcagtctttcaaattattcaaatgtagctgtgtctatagtgggactctatataaaatcagaaagatactgaacgtttgaatggagaatctaacactgaggcaaatgacctttaacatgtgagttatttgtaaaaatgaaaaaaatttcgagtgcttcattgaaatcaagaaggagataaagtctaaaaaactttcagcaaggagtgaatggtcaatggaaatgaactatacaaaatcaattatcttaaatttgaagacgtgtaagttactgatattctccttaatcagtatgctatctttttatctttttaatttagtgaccatgaagagtatccgtaagaacttttataggttcattttgaccttgttttcatatctattttctcctaaagtcttaatttttttttttgagatggagtctcactctgtcgcctaggctggagtgcagaggtgctatcttggctcactgcaacctctgcctcccaggttcaagtgattctcatgcctcagcctcccaagtagctgggattacaggtatgccaccatgcctggctaacttttgtatttttagtagagatggggtttcaccatgttggccaggctgatctcgaactcctgacctcaagtgatccacccaccttggcctcccaaagtgttggaactataggcatgagccaccatgcccagccaagccttaagtttttagataacatgtttttctgccacagagattttcaagaagaaagagtaccattctttgttactttctctctctgctagtagagtttctctttaacccagcaacttctttcatttccacctagaaggtggttgaatgctagatgttggagcaagccattaccagaggataggagacaaggtttttcgaattattgtagatcaaactgggaacccagctctcttgtcatgttcaaagagcagtagctgtgtttggacttcggagttagatatttctaagttcaaatccaagcttcacagggtgttcagataaaatctcacagaatgaaagaaacataggaaggattggaaggaatttgacatgtatcaaatctaactatcttctacaatgtttgagtaaagctctgatttttgagcatctctttgaccttgttttcttgagtagttggggatgagtccagcttcaatgtctcttgccttgagatcttacctttggagctttttatatccctcagttcgggcaagatagaacatcccattgtccagttattttctagtcctgtggtatctgtggagtttccagagccacactggtgctcggatgtctggagcatgttctcactgtggaaattaacctcgctttagttctagttcctaaggaagataaccaagagaacacaggtggaagaagcttgcatcaagaagactacactctatcttggaggtgaactgttcactattacatacataactcaggaaaacttagatacctctcttgtttcttttggcttaatggtggtaaataatttaggtgttactgagccctaggttattcaattgtttcttgtggtttctctactcccatatctttgtacatagttcctatgcagagaaaactctccgcaaattatcatgttttgagtaggctatctattgctttttggaaaatcagcaccatccatgtgccttaagagtgatttgcacatgtactcaggggtacagggaagtgaaggaggtcagttggaagaaatacaaaaaccaagatcttcattaagaagagtttaaaaattttgaaggaatagttggatctttttctaagaaaaatccttaagagatttgataatatgaatttggatgggaaataaggagtgtgctgtgtaccactggatttaggacatgagcgctggaggcccagaatgcacacataacccttctcaggcaacccttgaggctgtggtttggatactgaaccaagggtaaaggcacagacaaaagctgacattttgagggatcagtttatgaggtggagtaaaactctaagctggactctgccagtacccttttgaaaccctgtcttttttcctaaatgaggaatctcaattccagatagaaaatgaggacgaatggctcacgcctgtaatcccagcactttgggaggccgagatgggcagataacaaggtcaggagtttgagaccagcctggccaatatggtgaaaccccgtttctactaaaaacacagaaattagctgggcgtggtggcgtgcacctgtaatcccacgtacttgggaggttgaggctggagaatcgcttgaacctgggaggtggaggttgcagtgagctgagatggtgccactacactccagcctgggcaacagagtgagactctatctaaaaaaaaaaaaaaaagaaaatgaggacgaaacacagccttggttgaatgttctgccaggcagtgttctgtgtggcttttgagcaagtgcaagcacataattttcctatttgtcatctttctgaatctcaagcaagtgcttcctgcctggaagacattagttcacatatttgactcacgtatactctgaattttaagtgtattttgactctgcctctacagtggttaccacatgcttatccattatttattattgagttttatatgcatttgtacttttcaactgacccatatccagccattggtcatacatgagctttcccttggctctgttctcctgggccaattctgggcatggacttttaaactcaccttcccattttgacccagccattcctcagttatcccctcagctgaaacttgatttctgtgaatgcacttagtcactgagtgtggggagggaggtgacttgaaaagcaggtgctacatctcataattaaattatgtaatcctggtacttcagaatctcctggtctctgttgttacatttccttatgaacttctgaggggattaggaagtacttcagaacttcctttcctagtaggcatatgtttcttttttttttttttttttgagatggagtcttgctctgttgcccagactggagtgcagtggtgcgatctcggctcactgcaagctctgcctcctgggttcccgccattctcctacctcagcctcctgagtagctgggactacaggcacctgccaccatgcctggctaattttttgtatttttagtagagacggggtttcaccgtgttagccaggatgctctcaatctcctgacctcgtgatatgcccaccttggcctcccaaagtgctgggattacaggggtgagccactgcacctggccaggtaggcatacctttaaataatactactgattaagagaggcctgtgcatgttttgtggctaataagtaggcagaactagaataaataagatttacacttactggtctagacaacttaccttgggaattgcaacctaggtttggggacttgaccttccaagtctgtggactgacttgcaaactaaccatacttttcggcttgctaaccaagtcttgatctggaaagtaagatctccccgaggactgtcagatctacttgggcaatacttttcagtctgcattagaatcacattttaaaattccctatgcttaggtcccatcccaggtcaatttaatcagaatttctggtgatggagccagaactatttaaataaaagtctcccaagtgattctaaatgaaacaaagttggaaaactacagtctcaaaagataaattggactaaacctctagagttgaaaactcacccaaatttattgtacaagggtcaaaaagtggctgagtgccccatctgggatggtgaggcagatgaggggttgctggttactaatattggcattccttcctttcattgtgagttgctcttataacttgcacctgctgctctctagcaacatgagcctgaggtccaatgttaaactgaggcatgtgacacctgtgctcagatcagtgggcacccagggaccattaaagacttttctttcttacactctttgcctttgtgttccttggagaagaacttcaaaagagcaagcccttcctcagggccatcatggtcatctaaggtttagtacacattttagtaatgacacattaaagataacttaaatatacattttttgagggataaatatcaacatgaggaatagaggactcttggccaggtgcggtggctcatacctgtaatcccagcgctttgggaggctgaggcaggaggattgctatgggttcaagatcagcctgggccaatagtgagattcctatctctactaaaaaaaaaaaaaaaaaagaacagaaggctcttaattacctgtccaagctcttcagacaatcaagaccagtccttgtggagattaaaaatttcagaaactaaaagtttgttatagcttggtcattgctctcatgaagcagcataacttggtcctcctagtgctctgtgaatgtgaaaatgaaaactctctttgtctgtgcttctgttgctgttgctgacgtactctccacttgtctggtttattgataattcactctccagtattacactccatcctctggagggaatgatggatcccttcatcacaaaatgttttctgtatttgcactcttctatgattccctgctcatcccttaagacaaacccttctttaagtcccggatgataacaagagtgatgattgcagcactctgtatttattaagtgtctaccatgtttcagaaacttcacattagttatcttattcaatgctcttaataccttgtattggtccattttcatagtgctataaggaactagctgagactgtataatttatgaagaaaagaggtttaattaattcatagttccacaggcttaacaggaagcatgactgggaggcctcaggaaacttacaatcatggtggaaggtgaaggggaatgacacatgtcttaccatggtggagcaggagagagagacagtgaagggggaagtgccacacacttttaaaccatcagatctcattagtatcagttagtatcagtcagttttcacactgctacacttactacctaagactgtgcaatttatgaagaaaagaggtgtaactgactcacagttccacaagcttaacaagaagcatgactgggaggcctcaagaaacttacaatcatggcggaaggtgaaggggaagcaacacatcttaccatggtggagcaggagagagagagccaagagggaatgccacaagcttttaaaccatcagatctcatgagaactcacacactatcacaagaacagcaagggggaaatctgccttcatgattcactcgcctcccaccaggcccctcctccagtttgacatgagatttggccagagacgcaaatgcaaaccatattatgtctcctttgaagtaagtcttattgcccttattatatacgtaaagtaatcaaggtttagaaaggatagttaattttcccaaggacacatagctggttgatggcggaaccaagattcttctaacagactctaaaagttgtactctttccttttcataccaatatatttttaaaaatgggtagatatgctgaaagtttatcaggttttatcattaaaacctggggtcactgaagtaaagctatctttcactaactatctgtaaattgatagtcaactatcctgggaagttaagtgacccgccacccttaatatttagcatgaatcaatttaattagttcctttagtttcttcagacaaatggaagttatcttaaaggggatggaataaaggaagaaagaagcagttgtgcaaaaggaggtggaaataggtctcagaaaggatgctgttgaaatgaaggggcccacttttttttaaatgaaattgctttttaattcagttaagagaataaaagagatgaaatatgcagttatattttcttttatacttacctacataattacctttaccagcactttttttgtgtgtgtgcatagattcaaacggtattgtgtggtgtcacttgctttctgcctgaagaacttcctttattatttcttgtaaagcaatcttctactaacaaatttttccctgcttttgtttatcttgaatgtctttatttagcctttatttaaaactagcctattttttccagagatttaaaagctcactttatatttgctttctttaaccttttattttaggtttgggggtacatgtgcaggtttgttacataggtaaactcgtataacaggggtttgttgtacacattatttcatcacccaggttaaggccagtacccaatagttatcttttctgctcctctccctccctccactctccaccctcaagtagaccctagtgtctagtgtctgttgttcccttctttgtgttcatgagttctcatcatttagctcccacttataagtaagaacatatgatatttggttttccgttcctggttcctccagcatggatggagctggaggctattatccttagcaaactaacccaggaacagaaacatacatctcattcttttttatggctgcatagtattccatggtgtttatgtcccacattttctttatccaatctgtcattgataggcattttggttgattctatgtctttgctattgtgaatagtgctgcaatcaatgcacatttgcttgcatgtgtctttatggtagaatgatttgtattcctctgggtatatgcccagtaatgggattgctattaaatgtaaatggtaattcttcttttagctctttgaaggatcgccatactgctttccacaatggttgaattaatttacactcccacgaacagtgtatgtgttcccttttctccataacctcaccaacatctattattttttgcctttttcataatagccatactggctcaagtgagatggtatctcattttggttttgatttgcatttctttaacgatcagtgatactgagcttttttttgtttgcttgttggatgcatgtgtgtcttcttttgaaaagtgtctgttcatgtgggatccaggtttcatacagcaaacagaagcaagcacaggtgcagcctcatgtttgtttacattgattcagagtttgagctggtttcaccggtttgactcacagttttctttgttgaggctaggtgagttcctgctaacgactctgtaccacacacacacaaatcactcagtatcactcaagattagttctgttttaatgatgaacttagcattcatacatgtaatcctaagagtagttatagtttgtggatcaactcacatatgaccttaagatctcatgtcttctgacaagagcaatatggcacattggcttaagtgccgcatagaagacttgctagaccaatcagtgtcttctagattctattagaaatgctattttttaaatgtccagttggaaattttcaatggcttgtttcaagattaacaaattattgtggactctgtactgccttgcttgtcgtctcatactatgtgtaacatgtattatatgtatgcataacatataatatccttcctgatattatggtgtttctgtatagcacagtgtgattcttatatccacattaatatatttttacctttacgaattttgaatctttccatgcatttgtttaaattttactgttaaaatgggccaacatgataccacacatccaaagaagtgaaaaatatgccagcgaatgaaagaatacatttaccttgtttttggttattcaccaaggaactgtccatgcttgcttttaggttgccatgtagttgaatcttctgtcttcagtttcccttaaatgttctcttttttttttcttttttcaggtgagaccaggacaggtaatcggcagaactgacaataatttcttcagtttaagatacatttcaagagacttttgcagtgcggtttaaattcagcaacaaatggccgggcgcggtggctcacgcctgtaatcccagtactttgggagatggaggcgggtggatcacgaggtcaggagatcgagaccatcctggctaaaacggtgaaaccccatctctactaaaaatacaaaaaattagccgggcgtggtggcgggtgcctgtagtcccagctactcgggaggctgaggcaggagaatggcgtgaacccgggaggcggagcttgcagtgagccgagatcgcgccacggcactccagcctgggcggcagggcgacactccatctcaaaaaaaaaaaaaaaaaaaaaattcagcagcaaatattgatttctgtgtctgctcgtagttattaggcaatagaggcagacaaacacaaatgaatgctttatgtcctttgagggctcacaatccatttgaagtggaaagagagataaattccttttttttttagacttttttttttttttttttttagatgaagtctggtactgtcacctaggctggagtgcagtggtgcaatctccgctcactgcaacctctacctcctgggttcaagcaattatcctgcctcagcctcccaagtagttgggattacaggtgcatgccactatgcctggctaactttttatatttttagtagagatgggggtttcactatgttggccaggctggtcttgaactcctgacttcgtgatctgcccacctcggcctctcaaagtgctgggattacaggcgtgagccactgcgcccggtaggagataaattcttgactgtaatacgtgacagactggggcaaggtctatactaaagaagccatggcaataccagggaagaggagttaagtcctgcctgggaaaaacagatgaggaagtatttaatatggatctgaaggaagcataaattgtcacttggtcaatatggagagggaggacttatattccaggcagagaagagagcttgagcaaaagagtacaggcaagtatagagcatgctcacggaacggcaataaatcagtgagggtgggagagggaagcagaggaaatggcttaagagaacatgtatgtgaagccaagattgcattggattttgaattccagattaaggagcctggccttattcattctaccttcgccgaagagtcctacagattctgtgtttcagagggtaattttgattgtggtctagatgaggaagaactagtcaagaattaagagagacagtctacactgaatcagtttgagctggtttcatagttttgaggagacagaatctgatgtgttagcacatcacgagggcgagggacaggaagaaaacacaaataatccagaattttcaagttcaagtgcttggaaatattcatgccatgcacaagcaaagaaatggaatttagaggggtctaggattaggagcaaagacaatgaaacaaggggttatggagccccctttttactcttttcaaattttctggcatgatatactttctaagacattgacacattctcatcttattcaacctttggtaaggcattttctcatctcacaagatagaggtgatagaaataatgtatccatttatttctaaaagattatgtaaaacaacctgaaccagtttaattaggggaaaagattttgggtcgaaataattcagaattttctgccaaagaaaatgaaaataaattcactttaaatccttagcagtttattgggcatttgtcacatgcagcagtagctgaagagagtggcagtgataatgatgcagatgtagttacttattttcattcagtccttcaacctgctgttatcctcttcagggcagacttcacttcctggttcctcagtgtatagatgagggggttcagtaatggagtgacaacagtgtaaaacacagccgctgccccatccagggggtctttggagccagccctaaggtagatgaaaatacaggggacatagtagactgtgaccacgattaggtgggagccacaggtggagaaggcccggcgcctcccatcagtggtgcgtatcttcaggatggcatttactatgttggcatacgagagcagaattaacatgaagcaactggcggccactaccccgacgtccacaaaggtcacaagctcattgacagttgtgtcagcacaggccagtctcaatactgcggggatgtcacagataaagtaatccacctgattgggcccacagtagggcaggcggaaggtcaaggtggcctggatagacccatgcatggagccggcgacccaagctccagccacaaggactgtgcataacctcccattcatgagcactgggtagcgcaggggctgacatattgccaggtacctgtcataggccatcaaggtgtagaggaagcactgggtgctgcccaggaagtgaaagaaatacagttgagccacacagccaccaaacgggatagccttgatggaaggagtaaaatccaaaataagcagaggaacggtgactgaggagagccacatgtccaggaatgagagcactcccagaagaatgtacatggggcgagcacagagcttcgggtcagcccacatggtgagcagaatgagcaggttccccagctgagtgaggatgtaaatgatgaagaagaccaggaagaggaggcttcttagatttggggggtgagacaaacccagaagaatgaaatctgtcaccacggcatccagcgatgtgtttttggtctttcccatgtctttttgtagtctgctaagatgaatggtgacgtttgacaagagaaacacagcacaatgatgttgtaagtgaatgcttttgtcggatgattgatgcctaggaattatgagataaacaagatagagtcaaattgttttttaaaagaggaggtggtgtcaccattagttatttaggtttacttaaaaggagaagtcctccagaggctggttagtttcctagatgggaggaaactcttgtccattgagagatactgaaagccaggatttgccagatgaaggaagagggacacatgagagtgatagagaagtaccgaaaattccaaccaaaaagtgagttcgccaaggaggggctaaagttgatgcagagcagtgtggaacaaacaccctataatgaccacatctactttttcttcacctactatcattgtcccctttttcctcagctaaaatctcatctccttaacatatcatgcaaaaatattcctcatctggcccttatttatatcgctattgtaccacttgtaattccttcttattgttgggaggcatgacactcttcaagcttctcacagtagtgtgctctaacttgggacttacgcacacactatcttttctgctcccttcacataggtagtgcccacttttccttcaggattcagtttgagtgtcttcaccttcaagaaggctttccggatccctgaggacaatgcttatacttttctgagcacgtacattatgttgcattgtctaatttctgtttttctctcttaataatcatcccgtctagcatgctaaaagtgataaataccgtaattattttctgaatgactgagatagatagaatggatgttgccaaatccccctgactgaatacattgtttctcttgatcttttttgtctgacccctgtgctcacatggctgggacttttaggtcaagggaccacctcattcaccatgtaatatgggtataatttcattataaaaaactccaagaaacatttatgcctgtttttgctccaggatatcatttagatttatttgttgatttatatggttcattggtttgggattgggttttttttttggtatgaggtcacagaggaatttttattgtttgttataaaatcattgattaatgcaggacttgatctttagtgtgcttgtgtgtaatatctatgtattgcagtctatcaaacagcaactctctctaaagacatttacagattttcaagtatctgaacaagatgataaaatagagggatggaatgtgtttgtttcactctttttgttaaataggttgcttgataaagacttttcgctctatatatggtttgagatgcatttatctttcatttaactacaaaatatctttgtaatgcaaatgactactttcataaagcaattaaaatgacaatagattattataaataacatgtgaatattaataagtttaatctctatcggaaattctccaaagagattttatcttaagtattctgtgaaataacttaattcatatgttaacattcaagagttattagtagtaataataataatactgaatatatctggctcttcgaagtctggaaaatgttaaacttgtcctttgcccaccaagaacgaagaaatatcagatttttattgcctgagtttcaggaggacactttgatttatttgaaaatggatgggaaaactaaatcttatttttgtggttagaatatagagaaaagaggctgggcgtggtggctcacgtctgtaatcccagcactttgggaggccgaggcaggcagatcatgaggtcaagagatggagaccaccctgaccaacatggtgaaaccctgtctctactaaaaatacaaaaaaattagctgggtgtggtgtcgggcgcctgtagtcccagctactcgggaggctgaggcaggagaatctcttgaacccgggaggcggaagttgcagtgagtggagatcgcaccactgcactccagcctggtgacagagagagactctgtctcaaaaagaaaaaaaaaaaatgaatatagagcaaagatagaaagagttgagattaaaatggtgcataaaatactaattatggccaggcgcggtggctcatgcctgtaatcccagcactttgggaggccaaggtgggtggatcacgaggtcaggagattgagaccatcctggctaacacggtgaaaccccgtctctactaaaaatacaaaaattagctgggtgtggtggtgggcgcctgtagtcccagctactcgggatgctgaggcaggagaatggcgtgaacccgggaggcggaggttgcagtgagccaagattgcgccactgcactccagcctgggtcacagagcgagactccatctcttaaaaaaatatatatacatatacatatatatatatatatatacttattatgagctaaaagtaattttcttttctttctttttttttgtgtgattgagtcttgctctgttgcccaggctggagtacagtggcctgatctcggctcactgcaacctctgcctcccagattcaagtgattctcctgcctcagcctcccaagtagctgcgactacaggtgcgcgccaccacgcccagctaatttttgtatttttggtagagagggagtttcaccatattggccaggctggtcttgaactcctgacctcatgatccacccaccttggcctcccaaagtgctgggattataggcgtgagccaccgcgcccagctgagctaaagtaattttctttgccaatacaggaatataaactagtaggcttctacttaggcaaataatatattcatgaaatgttttatgaaaatccatttttatatttaaaatcagatagaactgtaccactggggcaattatttgaaggacttccatgatgcatactttcgtatagtgaaaagtttatccctaatttatctactttgccggtctgattttcccccttttgttgtgcctaagtctggtttcatttctcccaggctccctgttgaaagaaagctctttttacccctctaggttctgggttccctgcctgggaggaggcaggaaactgagatgggttatagctggtcggtttgaggacaggatacctttccaggcagacttggtaaagaacagtggttttagcttggtgtttggtattcagaggctgcagaggaagatagcttagacttccagaaggtagatttttggagaaacaaagagtgtgtttacagaaggattggctttcttggcaagagaggtgaacagtctgggaccaccttagaggagacaaaagaaaggccgggcatggtggctcatgcctgtaatcccagcactttgggaggatgaggctggagaatcgcttgggcccagaagtttgagaccagcctaggcaacatagtgggaccctgtctgtaaaaaaaattttaaaaattagccaggtataatggtgggcacctgtagtcctaatttctcaggaggctgagacaggaggatcactggagcctggaaggtcaaggctgcagtgagccatgatggtgccactgtactccttcctgggtgacaggttgagaccttgtctaaaaaaaaaaaaaaaaaaaagacaaatgtagaggccgtatttgtgtatcctcttttccccctcccttatcttccagatttgtgtcattttattttaggtctgttcctcttttttagcttttgaaacttatgatatttaagataaggaaagttaaatacaattttagtatatctaccctagctaattagataaccaaaatattctaaaattccccaagttttagactgtattggatattctccaattagataggtcagaatttaaataatcaaaacacatgaaaataacaaaaagttaaagttcaatataaaaagcatctgaaaataagagcccagtgacatcagagaataaacagcatatttttacaaagcaattatcctggaaactctaagaagagactttgggaatggggtgaaagagtagcactgagaaggtaaggacagggagggtcaagaacaccttcaagggacctctatggcattatgggatcacaggataagctgctttctatgcccctactctgccccaaatcaagctagtttgatatgtgaacacatttcttgcagtgtatttagagaggtgccgaggagggcaagcctctatccagcaatttgaacctagatttctacagtgacctttgggatctggactactatgcaacggttatgaaatcttgaagatgaggagtgaaggctggtccagcattgcgttggacacattatgatcaaaggactcctgtttacccttgtgacaaaactcaacccaatctgcttccaaaaagaagtttcaccttctgtcatcctttattcagagttagacatcctggtagagctagggcagagtagaggaaatggatagaatttgaggtggcctagacatattttatcgaattcacaagagtacattctttcctattaccgggggttaaaaaaaacgaacttgctttagaaaaagtacttagtgccctcttcattggagaaggggaaggttatgaatccagcctttctttgtgtttgcacaatcactgaagaatattcttcaagacccctatgactttatcactgcccaactctgccctttatcactgccctaataaaaagagaatatgaaaagaaaatagtgttgtaatgcttttttttgagtcattttctcaacacaaaaagagtttccccaagtttgaaaagaaggaacttaattctagcccgtttgggaaagagttgaggaaacgcatggagaaaagagacggattaaattaacactcggacaaaataacagaaagtcttaaagttccaaaattagtctgcagccttattttgaacatagctggtgtcaggcctgctttttccatccttttagactcacttgtatagagctgcacaattgtggaggaggctggctgcccttgagtgcaacggtccagcggatggagagatggtcttcagagattcagtctagcctactataaagggctcccacatctgtttcggaaagcctttataatttttttttaaggagtttggcccagcaaataagtgttcagaatctttgagaacgcctgtctttggggttcttggacaagtgtgacttctgtatatattcagtcatattttatatcagtttccatcagctgttgcttttttggattaaaagaaaaaaagacactgccaagagatttaaagaaaaattctaacctcgagggaaaccctactactctgaagtatgtccctaatgagatctttcctcaccaaatcctcattattttgttttgagagagagagctggaaatgtttccagtaggatccctggataaggaactgtggggaataaccttgtttgcatgttatttgaatgacctctaatttcttagaggtgttatgaagtctcaactgatccccttccctccccaaatactcatcaggattccaccatcatcttcaggtttctgttcaggcatcacctaatcagagaggtttctgttgactctctcctttcccttccctattttatttttctctcggcacttgccaccatttgacatactgtatttacttgtttgtttactgcttgtctcccttcactagaatgtgggttttgcttagctttgaatccccagcactactagcatagtgcctggcatgtaataatttctcaatatgtacttctgaataaattaatagttgaaactgccacacatgttaaatgctgtgggcagaaaaaaaaagctgtggtttcaaatataaatctaatgtttaaaattacctggagtagatctgacatcaaattgatcctcgagtgacctgcatataccagggcaagtagcttcggaaatctatttattcattttttcatatttaatgttgggcagggcacagtggctcatgcctgtaatcccaacagtttgggaggctgaggcaggaggatcgcttgcagcctggagttcaagagcagcctgtacaatatagcgagacctcatctcaacaataaaatacaaaaaattagctgggtgcctgtagtcctagctacatgagaggcagaggcagaaggagcgcttgagcccagaaggttgagcctgcagtgaaccatgatcccgccactgcactccagcatgggcgactgagagagaccctctctcaaaaaaaaaaaaaaaaaaattcatgttaatctaaataacagtgggaaattgactacaaatgaagatatgaagcctggagtgtgataaaagcttcaagagtttcaagaacttcccctgtaagatgatggagctcgacaaagactggatgatttctaagtttcttttaattctaaagtaagaaaatgttaggcgtgtgtgtgtgtgtgtgtgtgtgtgtgtgtgtgtgtgtgtgaagttgcactgctacctgttgccacaagatgacagtatcatctttattgaaacaaagtacagttgctatatggagtaaatagaaataaatccagagagttcatgagggatataaattactttggtaaagatattatatgtgaggcattaattagtttgggaaaactatgtatcaaaaagagttaacttccttttgtaacacatgggaaatagtttgaaatatagttttcttcctccctccgtcttttccttcctgttttacacctagtcttcctccttccttttttattctttctttttctttcttccacattctcagtttattatgtaacaaatttcaagtcaaaggaaacagagatatataagaaaaagttaacattttcaccatttcttttaatttcactcatctgaagaaactaatttttttttttttttgagggagttttgctcttgtcacccaggctggagtgcaatggtgtgatgtcagctcactgcaatctccacctcccaggttcaagtgattctcctgcctcagactcccgaggagctgggattacaggcatgcgccaccatgcccggctaattttgtattcttaatagagatggggtttcaccgtgttggtcaggctggcctcaaacgcctgaccttaggtgatccacctgcctcagcttcccaaaatgttgggattacaggcgtaagccactgtgcccggcagtaactaatgttaatagcttttttctcatttcttcctgtatattcgtacatgtacatacacctacagacatacaaattatgtttcttttgaactttaaattaatatctgatcatctgttgggagacaaatttagatggttgaaaactctctgtttcttccttattgtcacaaacaccaccaccaccactaccaccaacacacacacacacacacacacacacacacacacacacacacaccccacctctaattgcaaccttgtttccatttcttcctgtcttgagaagagaaacacttatggggaaattgaatactttgtctttttttttttttttttttttttttttgagacggagtctcactttgtcgcccaggctggagtgcagtggcgcgatctctgctcactgcaaactccgcctcccgggttcccgccattctcctgcctcagcctctcgagtagctgggactacaggcgcccgccacagcgcccagctaatttttttgtattttttggtagagacggggtttcaccgtgttagccaggatggtctcgatctcctgacctcgtgatccgcccacctcggcctcccaaagcgctgggattaaaggcgtgagccaccgcgcccggcctactttgtcttatgttattcccatttgccgtctctgttccttatacattatgctttttcaactttaccagaatcacttggattaaaacccgtggatttctcagtaggaaatgttcatgtgaagacacttctgtagtaacagaacctacagctgctcctgtagaaggaagttgaaagtcatcccttcaagaaaggggctcctccccttgtaattctactgggttttgcatccagactgagtttccttccctcacccacatgaagtgtctaccttctgcagactccaatggctcaggaactgggaatgcagtgccaggctcgtggtatcctgcagcagatgtggggagttttccttctttatgtttccatgaagatgggaggtaagtctcaatctaatagcaaatgctgctgggagttttcaaaacgattttctttcagctaaatgattgccatttctgacactcgtaacaaaagtgtttcttaatagatattttctttatgcggtgctaattgttattggatatcaaataataacgactttgctgccatttatttctaagaatctctccttaatggcaattcttttgtgaccacatggagacatcgtttttaatgataatgggtttccaggagcgctgccctagtaacagtcatgtatcttgtcttaggcactacaggacaaaacattgaccagcccactgagatgacagctacggaaggtgccattgtccagatcaactgcacgtaccagacatctgggttcaacgggctgttctggtaccagcaacatgctggcgaagcacctacatttctgtcttacaatgttctggatggtttggaggagaaaggtcgtttttcttcattccttagtcggtctaaagggtacagttacctccttttgaaggagctccagatgaaagactctgcctcttacctctgtgctgtgagagacacggtgactatgaggcctctttagctgcaccaaaattcaaaaggcaaccacagcagcgagaagctgtatttcctgagtgtatgcctgctgtgagttaagactggggactttggaaccagactgcctggatttgagtttgctactctctagttgggtggtcttaagtcagtcactatttttttttcttttggtttatttccttatccagaaagtgagaataatgagtatctacttcacaagcctgttgtgagttatgactctctgtatcatctatatctctatctatagctatatctagtgttactcagagaagtagtggcacacagtaaactttatttaagtttagttatttcaattctagtcttgaattttcactaagtattacgtggtaggacctctgagactggaactcagtatttctctacccttggtttgtggaaggtgaaatcctgaccactatttgtatcttgtggatctaaagctccacctaatgatggagtttgtcgttcaggtggattgttgctttggaaggatcactgtggtgatactcattttctttggggggactccgaactttggaaatccaaatgcaaatgcttcagagtgagatgttaagtagcctgattaattacgaaaggctatcttcattatgtgcatcctctataaataaatgtaatcttaacatattttggaggtttataactcagactagaagtgaagtttaggggcttcagacttggggagcatgaacataatcaggggagtctatagaagatgggaaaaagaatgaacataaacaatttggtggcaaatctgggtgaggcaggagagccagtaggagattcctatgacaagatgcagtcagtaggcattaagcacaataaaaatttacagtaaatgttaagattttcatttcctgctttataattcccttatgttctcttcaaatcttttaatgaagtctgttaaatgctacaacttgctgtcagctaggtttagagagtacacgattgctgtgtggctacctccacatgagataaagccgatcagagtgcagaagctcagattgcaggttattgggacatcaaaagtgagggctgctccaagttaacatagttatatggccagtcatatgttacatatatatatattttttgagtcaaagattaagcaaaattctctttgggtgagataggagtgctttttcattctaatttataaaatgaacatttgaggtggaatttgaacagacatagtcacactggaaagtaatcttgacaacatgaatccaggccactgaaatgttcatgttccttttgtctaataattcatttttttgagctctcatttaaataaatgcaggctagaaatgaggctttgtttttttccagtttacaagacaaccaaagaagccatagaaatgatatttaagggctttggacttggtgagtatgaattgttcatatagttatcaattagggaaaacaatactatgcaaatgatatggtgaatgctatgatcaatggaatattttaaagttgtattagtttctattgctgcataacaaattaccacaatacccatatattagcttgtagttctgtaggtcataagtccaagcaagttcagctgagttccatgcttagggcataaccatagtaaagtcgaggcattggctgggtgagtactcaagtgctcacacagagttcagagtcctcttccaagttaattctttaaatttttttctattttatatatatatatatatatatatatttttagacggtgtctcgctctgtcacacaggctggagtgcagtggcgtgatctcggttcactgcaagctctgcctccctggttcatgccattcttctgcctcagcctcccgagtagctgggaatacaggtacccgccaccatgcttggctaattttttgtatttttagtagagacagggtttcaccatgttagccaggagggtcttgatttccctgaccttgggatctgcttgccttggcctcccaaagtgctgagattacaggtgtgagccaccgtgcccggcctattttttatatattttttaaaatttagagacaaggtgtttctctgttgcctggggtagagggcagtggcatgatcataggtcactgtgggatcaaattcctgggctcaggaaattctctcacctcagcctcccaagtagctagggctataggcacatactaccatacctggctaattaatatatatatttttgtagagacagggtcctgctctgttgcctaggctggttttgaactcttgagctcaagcagtcctctggactcagcctcctgagttgtgattacaggtgctttttttttttcttttttttttttcggagatggagtcttgctctgttgctgaggctggagtgcagtggtaggatttcagctcactgtaacctctgcctcctgggttcaagcgattcttctgcctcggcctcccaagtagctgggattacaggtacctgccaccatgcctggctaattttcctatttttagtagagacaaagtttcatcttgttggccaggctggtctcgaactcctgacctcaagtgatccgctcgcctcggcctcccaaagtgctgggattactagtgtgagccaccatgcccggccagttcttattattgtcagaattctagtccatgtagatgtgggactaaagttcccatattcttaatgtttgtgggctgggggcatttctgagctccttaaggcaacctgcactctttctcatgtgagtcccaccatcttcaaacgagcaatagcatgtgaagttcatctcatgcttggaatctttctggcttaatcttccaaagttcatgtgtttttaaggtctcatgtcaaccggtacatagatatctcccttttgaaaagtcaactgtgggcctggtgtggtggctcacacctgtaatcccagcactttgagaggccgaggcgggtggatcacctgaggtcaggagtttgagaccagcctgaccaacgtgaaaccctgtctttctactaaaaatacaaaaattagctgggcgtggtggtgggcgcctgtaatcccaactacttgggaggctgaggcaggagaattgcttgaacccggaaggcggaggtttcagtgagccgagatcttgccattgcagtccagtctgggcaacagaacgagactccatctcaaaaaaaaaaaaaaaaaaaaaagtcaactgtttgttcagcgcggtgcctcacgcctgtaatcctaactctttgggatgccgagttgggcggatcacttgaggtcaggatcaaaaccagcctggccaacatggtgaaaccccatctctactaaaaatacaaaaaagttagctgagcatggtggtgggcacctgtaatcccagctactagggaggctgaggcaggagaattgcttgaacccaggaggctgaggttgcagtgagccgagattgcaccactgcactccagtctgggggacagaggtgattctgtctcaaaaaataaaataaaataaaataaaacaaaacaaaacaaacaaaaagtcaactgtgccatagaacccaacacaatcaccagagtaatattgcataacattcaagattctgaggattagggcagggaatcttgggtctattcactgaaattttacctaccacatagcaaataaaggatgtccattaagactgcataaaaatggtgaactgcttatgatataacaatgaatcaagaaaaccagtgtgcataattgaatatgcggaataatcacagctgtgtaaaaacttttgggcatagaaaaacagggaaaggaattacaatcttccctctttactgcatttcccttactcaaagtcttagtatgggtagattttcttctctctctctccctctagtctcttggctaggattggagggtgcacttccaagatggcttgctcacatagctgttgttggcaaaagtccccagattcttatcacatggctgtagtgtgttgacagagagagagacagagagagagagagagagagagagagagagagagccatcttttattgtccagtctcagaagtgttataccatcacttctgctgttttttttcccccagcttctaacatttttctccttttacatataacaaagtagaagaaataatataggattcaaactgcaaaagtagttaatcagtagaatgtatacacacacaaaatatccccataagaagacaggcttatttacaatgaagaaacacatgtacatttaagatagttctcatataaaacatttaaaaaataaaacatatcccacaatgggcaccactgtttacagcaatattaaaggggagaaaacaacactcatttaatggtgagcattaaatgtaaaggtacagcatcagtggaataaattcacaaaactatattacagcttgttaatccatttaagaattgttccaaatatatcatatatttggccctcagaggttcattcctacagatttcaactactgtaaatttctagctactgagaggtagaaaatggttattatcatgattataatgattattagaaacacacacacacacacacacacacacacacacacaaactcaccaaggagttacaaaatctatggagaccagaggccaactatcatcacctcatgtctgctctcaccaacagccttgcatttttcagagaactatctaaaaaaatagtcagacaccagtgtgatcactatctcctatgccaaacctattgggaatgaaacaagcagtattaccataaatgagaacattgaggcttacctttcaaggcttattctggtctcagaaattaattagatacgattattttctattgaaatgaattttagctaacataaaagactagtcctttactagctggtcttagggtaaaggtcgtacacatgagtcttaacctactctctgtcatagctaaagtcagctgaaaatccaaaattaaaagtatgccaaaaatcctaagtacaatcttttggaagtctgctgtgaaaaagcctttaaggatgtactaacttgaagtctaagtgcaaggtcataagagctctaacgctgttagatcttcctcgtttgggagaaaggatcaatgttccctacaaaacgctaagttttgcataaaggtgaaacctacatatactagggtatagaattaatttaattttgttccatcaggatcctttttccatggtaaaaaagcagaatgaggaatgaaggaatgaatcttttttttttttttttttttgagacggagtctcgctctgtcgcccaggctggagtgcagtggcgcgatcagggctcactgtaagctccgcctcccgggttcacgccattctcctgcctcagcctcccgagtagctgggactacaggtgcccgccaccacgtccagctaattttttttgtatttttagtagagacggggtttcacagtgttagccaggatggtctcgatctcctaacctgtgatccgcccgcctcggcctcccaaagtgctgggattacagccatgaaccactgcgcccggccgaggaataaatcttaattggcctcttcatcagaagaggtaaacttggtctctgtattcatgaagctagacagttttttaagcaggcagtggaagcagacagtagaacaagattcctgtagccacagaccactacctggtatcaaactaaagcaaggatcaacttaaacaattatccaaagtcattttaactgtactaaagggtaaagttcaccactgtattattttaaaggaagttgtttaatgtaagaattccattaaccctgggtgagaaaaatcaaaacaagtcatactctctaatgagttatccatgtaagaccaccaataaaaatgcttttaactgtatttgactcgaagacacttacttggtaagtgtgaatttctttcttttttttttcttttatcccattggatttagactattgaataattaagggtagagtgagggagaacaaagagctacttctttaacattttagtatctggatagtatagcagaaactgttcctagggacaatgtatatgccattaatcacattgaataaagtggatgaattattcatttttcttttctttttgttcgagaagcttgtttatctccctttggcctttccagtgtggtttgaaatgattccgtgttggtttagttgaggaagcaacagtaagaaagtcactgtcaggtagctgagaagcaggttgtggacttgctgtcccatccaaacaactgcagcgagataaatgatcatggccatgaaacacatttcaggcttttcttccttcagtgcgaagatttgtttccaccagtccatagctctgcattgagtttttagtagattgctgcaaatttcatggaatttttgctgttgattgctggtgcatttattggagccaaaaatgttaggtgctagaatgggaacaaggtagtcagccaagcaccaaaacacaacaaaagaggaaacagcagacagaacagatggatctagatagtagataattgaagcaccaaagaaaccaagtccatgatggcaggtgaaaaccaagctctttcccataataagactttatccaccatcaacatcacttttccccattcttgcagctattgttctaaacttgcagtctctgcagccagcaaattggtgccgtggttacctccctctgccatcatccctgaagtgctgtctcagcaagcacaaaccaccctccaactcagccttcctcctgagatccacagggcgattctggccacttctgctgtattctgttggtcacacagacccacccttatacagtgtagaaggcgattgcacagtggtgtgaataccagagatgatggagatcattgaggtcatcttgttgactggcttccatttaccaactcctgtcagccattggttgaaggatattaattttattaattaccagggatattaattttctagtattcagggtttactatgtacatgggcaaagaaagcgccagttgccagaaagatcccctcaggcacagaggtgctgacagttgaaagttgggccgtccatggaaaatgtaaacgggttatgcagaggagggtattgatagtgtcagtcaacccttccactgctttgataccctcttacccaacattatatttgctttgtactgtcattgattcctcaaggtggtggctgattacagtttcttaaaaaaaaaaaaaaaaaagacctaaaacagaggatttagccagataagtagagttgttgctgcagttggtcccaagaccatcactgttatctattgtctccctcttctatcactcattctaggctccctcattcagcattcctgctggtctcagtttcttgctctttggtgactcagaccttcatccctgaagggcccaagcccctggttactgtacccttttcagaccttggttgatgcaattacctcttcactgctatcaccaagcatggaaacaccaagacatgttccaatacatctctgagttccattggtacttctctctatccccgttacatagtagcaactctatatcctcatgatagtagtcaattacctctgccactatagttttgccaaatttggggagttttcaggcattatttctttgaatactttttcagtcccacttctttcctcttaaactccaatgatatgaacttagatctcttgttattatcccataggtctctgaaactctgctcatttttctttcagtctattttctccctgtttttcaaactgagtaaattctattgatctgtttaaagtttacagattcagttctctggcatctcccctttatattaaatctatccagagagctttttaatttcagttattgtatttttcagttctctggactcagctgctgcctcaaattcctgggcttaagaaatcctccttcctcagcctcccgagtagttggaactacaggcactcaccaccacgcccagctgattttcaattttttgtagagatgggatctcactatattgcccaggctggtctcaaactcctgggctcaagtgatcctcctacctcagcctcccaaagtgatgggattataggcatgagccaccatgcctggactcacttattgaagcatttttgtgagagctgttttaaagtccttttccaataatttgagcatctgattcgtcttcgtattgaatcagttgattgtcttttctcatttatgttctgatttcctaattcttggaatgaaaagtaatttttgattgtagcctggacattatgggttttttattaggaaacctggatcttatttaatcttctttttagcaggtagttctcctgttgagatgtagtgtaaagtttggtgaatatatatgttcagtttcctgctgggtgccactggcaccaccccaccaaaaggggaccattaagtcacattgccttattgcctctgaatggagatgatcagctttctgctgggccagctgggagaggggaaaggagagggccaactagacttacctcctgcctggttggtatggcaggagtggaggcttagctcaccagtggtccttgttgacaagggagtgggaacaggaactctgattagccctactttccattgctttgttcaattacatggccactggatgggtgtggaggttcagctcctcactgggcattgctgacattggggtgggggaagctgagtgtttactgtctcacctcatagcacctcattctacctcattgttgctaggtagagatggaggctcagctcattgttggacctcactgacagtatcttgctgggagactggagcaccacctgcttctgccatctggggaatggaagatcagctccctgtttggcctgctgacactaccaagggggaaaccagagtgcacagtggcttctattgggaaggaaggtggggtggaagatcaacttccttgctcactgactgagacctgggggtgtggtttatttgttggtgtttagctggagcaggaagggtattgccagaaagatttcctgctgttaggccaccgcctttttccttgtcctttggctagaaggaatgggctttccttggagcttttgttatctatgcatattggtgtctccaggttggaggtttctgtaacatcctgtccagaaatttttttgataaatattagggtggtatattatttttccttttttaaaaattctaatgtagttattgatatgattggtttaaatctaccattttgtgatttgttttctattttccccatttcttctgtgttcattttctttcctttttggtctagattgagtttttttgtatgtttgtttttgggttttattttagtatttaattttatttcatcttcactataatcttattagttatattactttatgttagctgttgctctagaatttagattatacatctttaatatagtataacttcaagtgatattatatcatttcctgtatgatataagaaactttcaaacttctgtttttctcctcccaggctttttgttattactttaatatattttacttctacatgttataaatttcacaatatatttttgctttatatagtcaaaatatttaaaaagcgatttaaaaactgattataaaacactttgatatttttgccttacttataaagattaccttacccagacaacctgtaaagtgtggagaatatagatttatagatattgctttgaacatctgcccaagcagtagaagaggcaaattaggaagtgtttagcaagatgcttctggaagctaagttagttcgaggctgtatatcaggcatcctgggtacccactgactggtaccaatttacttagtgttcatgggtgaggtttcacttgtccatggactttgaatccctggtgtgtatgcagtggttattacagtggctctacaaactaatgtcatgctaattgccaaaggtttggaactcttccatatttgaaggcttctggattttttgtccacttattaaatggctaaatgaatgagactaataacaggaagggcattggaatggaaaacttttaataatacctccgagtattcattgatggcaagttcagttatgtcatgtgatgatcacttcaaaatcctgtgtcagataggtaaaaattccaaagctttcaagcctaaaatttaccctgtgcagaattttgagtttcatgattttatatcctaggcttctataatagggtatcagaggcgaatggaatcattagaggagatacagagtagatggtaagtgtgtgatatatattgagaacatttattttaaacaaataagatagatagtttttatgtataaacaaatgttactgattatacattgaagaatattgctttggactttagaagacagcctaagcttaatagagctcctgggttgattgatttgattttatgatgctgagttttgctatcctcttcctgcctcacctttataatgtgatcatgattattgttacttatttaaggtgggtgctgaggtgaggagaaaggagataataggctctttaagaaaagcttatctcctgagagtgataaatgtacagtggtcttcctaaacttcaccacagtcccatcttgatgatcattgcaaagaaggtaattatattagtcagagttctccagagaagcagaaccaaaggttttacacacatgcacgcacacacacacacgcatgcacacacacacacgcatgcacacacacacatgcacacacacgctgcatgcacacacatgcatgcacacacacacagatgcacacacacacacacgcatgcacacacacatacataaattagtcctttggtatacatgggaggattggtttccaggatgcccctaccaatagccaaatctgtagtcatccctgcagaactggtatatactaagttgaccctccatatacatgggttttgcatcctgtgagtgctgcattttcaatctgcgtttggttgaaaaaaaatctgcgtataagtggactcagttcaaatccgtgttgttcaagagtcaactgtgtgtatatacattatatatataaaatgagagagagagagagagagagagagtcagagatagcttgatttattatgagactgtggattgtgggtttggaaagtttaaagtattcacagcagggctgcaggctggaaattccagcaggagttactgttgcagtcttgaatctagaggcagtctggaaatagaattctttcttcttcttaggacctcagtcatttttcttaaggccttctactgattacatgaagcctcgccacattatggagggcaatttgctttacttgaagtctactgatataaatattaatcacatctaaaaaataccttcaaagcaacagctagatcatagtttgaccaaataactgggtaccatggcctagccacgatgacacagaaaattaactattatagtaattaaagggataaaattattacctgcattccataatgaaaataaagagacttgctcaagtatacgcagagtaatatatgagttggctaaaggagcaaaaagaagcagaatccaaatttatatatgtatattgacaggaaatatgctttcatttgacaatatttattagttctgatgcacaagaatagactaagacaaattggctttgatttgccacagaccccttaaaaatttttgtattttcttaccgggccccatggctccagcctataatcctggctactcaggaggctgaagtgggaggatagcttgacaccaagaactcgagaccaacctgggaaacatagtgagaacttgtctctaaaaaaattcaaaacaccaacaaactagccaggtatggtggcatgtgcttgtagtcccagccactgggaacgctgaagtgggaggattgcttgagtccaggagtttgaagctacagggaactatgattgcaccattgtattacagcctgggtgacagagcaagactctgtccctaaaaaaagttttaaaaattttcttaatacaaaactttaagcttaatgttagtatcaagttatatcccctaaaagtgtgctttctattaatatgaactaaaaatgaatactttttttctataaaaaaatttgttgaatgcgtcttaaaatgcagttccaatggtgcccatggtagttactgattaaagtggtaatggcaagtagacgtagttctgtcttagttggcctgacaaaagtcaaagtattgtaaaggaaaaatgtaaaatttgcagaaaagaaaaaggattaaaaaaaaccaaggaccaatattaaaaaggcgaaaccgctgggcgtgatggctcatgcctgtaaactcagcactttgggaggctgaggcaagagaatcacttgagcccaggaatttgagaccaaccagagcaacatagcgaagcccctgtctctacaaaaaaaccaaccaaccaaccaaaaacaaaaaacaagaaacacaacaaaacaaacaaccaaaaaaaaaaaagcaatgaacaaaaaaacaaaaaattagctggacatggttggtgtgtgcctgtagtcccagctacttgggaggttgagatgggagaatcgcataagcccaggaagttgaggctgcaatgagctgtgatcatgccactgcactccagcctaggtgacagagtgagactctctctctctctcactcacacacatgtacacatacacacaacttaaaaaggtgaaactgttcaaacagaaagccagttactaatatccaaatcagagtgtattttatttcatgttttttaggattttgctttttctgtttcatttctagaaacaattatgagaaaagtgaatgaaataacattatagtaactttataacaattagctaaagcatccctgcacaactggagaaaactggtaagttttaccactacctgcgctgcttgtcatgctttttgtgggtctgcacatgtatgctcatatgtacattacgtacttggtattgagcaagacttgtctgatatgtcacttaagtgtgtgtttagaagtttaatagaagaccttttaatttatgagagttgttttaacctcttttctgtctaaggaatcagaatacttttttaacatgttgctgcctatgaaggcacctgcacacacagacaaaacacacatacgcacaccctccaggattcctcaagatgtctggggttacgacttgtcacctttagagtttgccacagcactgatttctttttcctagttatcgaacactccgtaggttatggagtcttgaggttgtaagggatcaagaccatcacttctgtttgctttttggatttgaatacctagaacagtgcctggaatatagcagacactcacacataattataggatgaatgttgaatgttgaaaagatgaagtcttttttactggcagatggccattcagtctttgtttctaagagcaaggaagtccttacgcagcaaacctgtgctctgaaagtcagtgtacagattagttttgggctgttctggagaagatttggaggactacagttgaggcctggtagctctgctcctctgggatttcttaccctgggtcactctttgggacataactcaccatgactacatcattgtaatgtatggagttgtgatgttaaatgcttccttccttccttccttccttccttccttccttccttccttccttcctttctttcttccttccttcctttctttctttctttctctttctttcttctttctttccttccttccttccttccttccttccttccttccttccttccttccttccttccttccttccttctttctttgtttttctttctttctttctttctttctttttctgtctgtctctctctctctctctctctcccccttcccttcccttcccttcctttctttttttaacggagttttgctcttgttgcccaggctggagctcggtggcacgatcccagctcactgcaacccctacctcccaggttcaagccattctcctgcctcagcctcccaagtagctgggattataggcatgcgccaccacgcccagctaattttgtatttttagtagaaacggggtttctccatgttggccaggctggtctcaaactcccgacctcaggtgatccaccccctcggcctcctaaagtgctgggattacaggcataagccactgcacccagcctctaaatgctttctatgtatgcagaagcaaggacatcattttgttcttaccctacacaaccttcagctctaaaactttcacagcagttttttttttctcagagatttctttcccagttttagttggtaactgagtagatggtctcctcatatacagagaagaatcaaatctttaaaaaataaactaaatttaatatgctgaaagggatttaggagttaatccaactcagctctctgcagccaactattgagtaatagaaaggcctagggacaggagaattgggacagaattccaatcttgccatgcaaaagctgggaaagccacaaaacacctctgaagcttacctgcatcccattttattagggagatgaacctgtcaaaggttagagcgtgttcctatgaacttctgccttgtctcttcttgagggtttaagccctggcattcaatcagtataggcagttctcttatatcagatccatctaagcaagaccttggaagctctggattttacaaatccatttgaggctaacacgataatggtctactgtgatggaaaatcatgttcctcttggcaaaaggagccttctctaagtaacacttctctaagtgggtccttgccaaggattgagcctttagtgctgaaagagagatcaggtagaaacagagacaagaggcagagaaagatagggttggaggtatcattgatgaaaagtaaagatgagtaggctgaaactggggtcagggagtagaggtcactgatctctggaaagtcacgatactcttcagaggtatgatttcaaaaaggggaaagttgttgctgtctacattgtggagctgctgtgggaactctagagctcttggaagaaaggtaaaaaaggtagacaaagagcaggaagagatagatttcattgaccttcagtttttttttttaaatgaagaattctaatatacgcagtatacaatacacaatactgatgtctagtggggattctggtgcttttagctcaattgcccctttgtaaataagatttctgctgattgccttaaaatgggtaattattttgatgtacagatcaacttacccccaaatttttggatttttcataattcttccttgcagtgctactttgaaaatatctttaaaaattttatttattttatttttagacagggtcttgatctgttgcccaggctggcttgcagtggcatgatcatagctcactgcagcctcaaactcctgagcttaaatgtttctcctgcttcagtctctggagtagctaggactatagacatgtgccaccacactcagctaattttaaaatttttgtagagatgcagtgtcactatgttgcccaggctggtcatgaactcctggcctcaagcaatcctcttgcctcagccttccaaagtgctgggaggctgaggcaggaagattgctttgtcctacttttaaaacattaaaaaaattaattcaataagtattcagtgagttcttcctttatgccagttactttgctctgtggatagaaaaatgaatgagatatttcccttccttcagggagtgcatagttggatcttattgctacttaaatcccattttatgtttttttcttttagttctttggttaagaacgtaggctctgaaaaattcaaattccattttagccagttgctgagtgaccatgagtgaattatttaatcttgcaaatattttgggaagcaatttgataataatatattttgaggtataatctttaagctagtaaactcatttctagtaatctattcctaacggaataatatattagagaagttataatcgttcaaaaatatgtattgagcaactgctatgttctatatactttcctagataatttggatgattcatagagcgaaacaaagatccctgtccttttagaatttatattctagcagcaggagaaagaaaataataaacaatagactaaataagtgaattatacagtatattagaaggtgatcagtgctttcaaaaaataaaaaaggtagatcaggataaaggggatcaggagtgctggaattctcggtgagttttagttttatattatgttcatcagcataaaccttgttgagaaggtgatgtttgagcaaagacatcaagggggtgagggagttaattatgccagtggtccccaacctttttggcaccagggaccagtttcatggaagacaaatttttccatggactgggggtgggggcgattggtttcaggataaaactgtttcacctacatcatcaggcattagattctcacaaggagtgcacaatctagatccctcacatgtgcagttcacaatagggtttgcgattgaggatttaatgccaaggctgatctgacaggaggcagagctcaggtggtgatgctgaagcactcacctcctgctgtgcagcctggtacccatctgtggcccaggtgctggggaccccagaattatgggatatctgggggaagagattccaaacagaggaagcagccagtgcagtggccccagagtgggactgtgttttgagtatttgaggaataccaaggaggacaacgtgattggagctgaaaggaagagtggtaggagacgaggtcagagaggaaatgggaagttgtgtcattgagggctttacaggccaaagtaaagacttcacttacaatgtgtgaacagggagccatcgaaagtcttcgaattagtgaaatgatttaatctgatctatttttttttttttttttaaagatggcatctcgctgtgctgcctaggcagaccttgaacttctggacttaagcgatagatcctccacctcagcctcttgagtatttgggactacaggcacgtgtcactgcacccagcttgacctatgttttaataggatttctcactgtaatgttgagaaagattgtaccattatttttaatagtgagaaattagaaacatcataaatggccacaaaggatggactgggtgcacacatttgaatacatatatgtgatgaaatgtcacttggttatacacttatgatataatactgagtgaaaaatagaatataaaattatatgtttataatacaattggaacaaattaaagataacagcagtaggataagaacaagctatgggtattcttctcacttgcttttccctgtgcatgcttttaatactttgttttaaaacaaagtaacccatgcttattatacaaacttgaacaattatgaattataatgtaaaaattaataaaatcctatcatttccttcaattccatacttctagaattaactaatgttaaaattgatgtgtgttcgtcaacaactatcttgtgtccttctaggaataaatatatacaaacataattcatgaatatgtatatatgtttgaatatgtataaatattaatatgttgaagcatatgcatgtacatatatgcgtaaatatatatgcatacacacacaaatctttttcgatttctttcttcctttgttcattcattcctttgtccctcccttcctcactccctgccttctttccttcaaggttcgtaatatactcataataggttcttttgcttaacaatatgttattgacattccatgaattagtagtttgtaatcttggctgcacactggactctccaaggagtattaatagtgctgatgggtccaattgtcagaaattctgaattgatggtttggcatgaggcctgggtatcaaaatttataaaacttctttaagtggttctaatgtgcagccacattgagaaccactgccttaggttatacatatagatccaactcattattattattattcttaatagctcataatattccatactgtggctgtactaaaatgtgtttatctagtcctctattgagaaacattcagtttgtttccagtatgttattctactaaaaagtctttaaacatgtatctttagttctttagttaccagtttctttatttctacaaaatacagtcctataagtaaagttgctgggttcagaggtatgagtgtttaaaattttaattggcactgctagattattttccaaaaagatctcaataatacctacttctagtagcagtgttaagagtactcctttccttatatctttgttaatccgatgaatgacaaaaagtatttgattttctttttaatctattactaattaagcatatttttattcatacttatttgtcatttgaagttctttttctgtgacttaagtatatctttgctcatttttaattgagtcgtttgtcttttcttatcaagttttaagagatcttggataacaggagtattcttttttggttatctatgttacaatattttcttcacgtctaccttttttttgataatttatatggcactatatattttgttattattattatttttttcagacggagtcttgctctgttgcccaggcttgagtgcactggtgcaatcttggctcactgcagcctctgcctccctggttcagttcaagcaattctcctgcctcagcctcctgagtagctgggattacaggcatgcaccactacacctggctaatttttgtatttttagtaaagatgaggtttcaccatattggtctggctggtcttgaactcctgacctcgtgatccacctgcctcggcctcccaaagtgctaggattacaggcatgagccaccacgcctggctggcattatatattttaaattattgagaaagtttaacacgctttatctcatttttattcattatgtttaatattttttcacgttggtaggcctttgtcactattgttcctaatgtaagccccatgacattgttcctgatgtaagccctgtgaactactgttcctaatgtaaacccctaatgtaagcctcacgttattttaaataatactatagttaatatttccttgcatttagcttttttcatagtttgaatgcttacaagtgaaataattggatcaagaatataaattatttttgtggcttgtgataattatttcccaacggttatagtttttggccagccatcagtataaaaagttagggtaatataactttagtatttatacaataatatcatattacgtaatttaaagaagtaagtttcttaagtattttcttagctccattgtgaaggaaggcttgagttctttttcaggctgcctaagaagttaggttcagttcaagtaaaaattgtttttgcatacccattgtgtacaaggcacctactaagtgctgcaaaggataagtcctgtgtggttactactcttaaaaaaattttagtctgggcgcggtggctcacgcctgtaatcccagcactttgggaggccgaggtgggtggatcacgaggtcaggagattgagaccaccctggctaacatggtgaaaccccgtctctactaaaaatacaaaaaaattagctgggtgtggtggtgggagcctgtagtcccagctacttgggaggctgagataggagaatggtgtgaacctggaaggcggagcttgcagtgagccgagaccatgccactgcactccagcctgggcaacagagcaagactccgtctcgaaaaaaattttttttttttgatttagtggagagcaaaaatgaacatcttattttactttattttacaggtcaaggaccataaaagaagcctgagagggaatagataggctttgactgggtcaggaaagttttcttaaaggtagtgttctttgaaatagtcaaagacaaagtgaaggatgaatagtatttttttcttcacctttaagttcatggataagtgtgcaggatgtgcagttttgttacataggtaaacgtgtggcatggtggtttacagcacagatcgtcaggtattaagcccagacctccacaggtgtagagtgggtccacgtgttctcattattcagctcccacttataaatgggaacatgtgatgtttggttttctgttcctgcattagtttgctgaggataatggcttccaagtctatccatgtccctgcaaaggacatgatcttgttcctttttatggctgcataatatttcatggtgttatgtaccacattttctttattcattctatcattgatgggcatttaggctgattccatgactttgctattgtaaacagtgctgcaatgagcatacatgtacatgtatctttataattgaataatttattttcctttggttatatacccagtaatgggattgctgggtcaaatggtatttctggttctagatctttgaggaatcaccacactgtcttccacaatggttgaactaatttacagtcccatcaacagtgtaaaaatgtcccttttcctccacaacctcaccaacatctgttcttctgttgttttttggctttttcataatagccaatggtatctcattgtggttttgatttgcgtttctctaatgatcagtgatgttgagctttttttcctgtttgttggccacataaatgtcttcttttgagaagtgtctgttcatgttctttgcccatttttaatggagttgtttgtatattaatagtaaacaatgaggtgaggagagtacacttgaatagagtgtatgttttctgagcagagggaaaagaaaaagtaaagacaaagattttggaaggtaagtaggtggaggtaggatgcctggaggacagtgacttgcttggtcagagagaagaattaatagggagaataaaaggacactcacattgaaaaaatgaaaatgtgcagcagactgttgcaggctttgaatgtatatctaatttgatagaagagtcaaattatttagttgggagttgtattggaatattagcttaatgttatcagtgctttagtttgaagtgaaaagagccaaataactaatgtgtaaggtttcgggcatttatttattcttgtaaaggctcactgatctcatctgcaaggcagaaacaattgattcatgtgccatagggtggttgtgtttaaatagaagtgcctggcatggctcctggtaagtagtgggtatactgtaacaactactgttaaattgatttcataagctatatgctctgatgataaataagcaattcagataagaatacaaagtcatttcaattagttctattcctataataataaaactaaattagctttcattttttcccccctaagctcattgaatggacagtctaaaccaaacaagagtgactgaatttgtcttcttgggactcactgataaccgggtgctggaaatgctgtttttcatggcattctcagccatttatatgctaacgctttcggggaacattctcatcatcattgccacagtctttactccaagtctccatacccccatgtatttcttcctgagcaatctgtcctttattgacatctgccactcatctgtcactgtgcctaagatgttggagggtttgcttttagaaagaaagaccatttcctttgacaactgcatcacacagctcttcttcctacatctctttgcctgtgccgagatctttctgctgatcattatggcgtatgatcgttacgtggctatctgcactccactccactaccccaatgtgatgaacatgagagtctgtatacagcttgtctttgctctctggttggggggtactgttcactcactagggcagaccttcttgactattcgtctaccttactgtggccccaacattattgacagctacttctgtgatgtgcctcttgttatcaagctggcctgcacagatacatacctcacaggaatactgattgtgaccaatagtggaaccatctccctctcctgtttcttggccgtggtcacctcctatatggtcatcctggtttctcttcgaaaacactcagctgaagggcgccggaaagccctgtctacctgctcggcccacttcatggtggttgccctcttctttgggccatgtatcttcatctatactcggccagacaccagcttctccattgacaaggtggtgtctgtcttctacacagtggtcacccctttgctgaatcccttcatttacaccttgaggaatgaggaggtaaaaagtgccatgaagcagctcaggcagagacaagtttttttcacgaaatcatatacataatgggcactgggattgcagacataattgcagccacatccttaatgaaagagcaaaagtaaagagtcaaaatcaacttatataacttggtaaattaggtaaaatggcatagagcaggtcagatttctgctcattaaagataagaacttattctgttcattaaagataagaacttattaactattatttaaataaagcaaaagatcatagtggaagttataaggaaaaataacgtgggaaagtttaaagacagcttttgatttcatcagtaaaagaatacaatttggggaactcagttcagtctcagtttcaggagcaggtagagtgagaattgactctcttgatttatactgttctgtgggctattgcctctgggaagctatacatcactcctgtgatttatacattatagtagtttcaatcttgttttccaatatattttcaagtgtataaataagcctttacttatttatattgaattaaacttttgttgcttttgaatgtaattctctcatgtctagatctattttgtactttttttttgagacaggaattttttgtactattcctgcaacttcctgtaagtctgaaattattgtcaaaataaaaagttaaaacaaaacaaaactatacacccacaagaatagtaaaaattaaaaaggtagaaaataccaagtggttttttttttttttttcctaattactctgtcgcccaggctggagtgcagtggcgccatcttagctcactgcaacttccacctccaggtttaagtgattctcctgcctcagcctcctgaatagctgggactataggtgcatgccatcatgcctggctaatttttatatgtttagtagagatgaggttttaccacgttggccaggctggtctcaaaactcctgagttcaagccacctgcccctctcagctaatcattaactactatcactcattgggctgaagtatatcagtttattgtggaatgggcaagtccatatgaagagggatccatgacaaatttcttaggtaatgatgatgatattctgtgactgaaataagtaggattagctgtaaatgaagatcctatagatggtcagagagctaccatacaatatcaactttaatggagctgatggaatgaaatgaaatatggttaataataaaaatattaagtataaatatgtttctttgcttattctgaaaaaaatttataattgattggggtctttgtcactattttccacatggtctgtcaacttatagaaataatacttgagtattctggagaactggagagcagacaacatagccatccacacattacagacatacacaatacagagtgagtgacccactaactctaactaaagagtaatacatgattaccttttagtaatcaaaaggacaaagaatcagaagcagtctattcattaaactgagagatgctcatgaaaatatctaaatatcattacttcaagttgacaaacaagggtagaaaatggtcagtcccctataattctcatataaaacttgagtcatagtaagagttttagatatctatgatgaaatgaagtccagatatcactactatgtacatgttaaaaacttagaaaaatgatctaattatgcctctagtttctggacttttatgtgcataagtattcatactcattaatatcttttatgcagaaataaattcccactgtcttatttgtttatttgtattatggcactattcattattttaccgtatagaacatggttgtaacctgaagaattcaattgttgaatacaaagttgctgagcagatttctatattaataaataatgattcctctctcctgttaaagtaagtaaaccacagagccaagcatcaagatcttttatttttgttctttaagactctctatttatttagtgagtaattaaatacatttttatcttgtctctgagtctgaaaagcttttttctgtaaaacggagacaaaatgttttatttttacgtccccagagagttgaaaaattagtgtgactaaaaacgggtagtgtcagaaattttgcttgctgctatgaaaaaaataagcaaacatcacaacgttgttccgttatagttttaccagctacaatcttaatggctacgttgaagcattgtgttgttgacagacaatatgacaattttgcacgtgttcctctgtatggctgattcctgcacaagcagttccatttgggctcattggaaagatatttagatatttctccttattgtctgccattgcctataataaaagggcatttattttacataaattttataattcttgtgtcacttgaatatccttcctaacacatttcctagcaaataaaaattttcctcctaaaaatcatgatgtagaccttgtggctcacaggtttattgatcatacactcactgagtgcctaggaaatcccagctgcatttaagcatgccttttttagcgatgatgtgagaacaaactgatgatttccaatgtgtcatgctcttttgtaaacatgaatatgagatgccgttatctgggatatcctcttcatatcccagttgattcaccacattccattctgctacactatgtgccgccacagtgagatttaagatgttggtttatagacaatggtttatccaacttggtgttttctaccaagtttctaccaagttgttttctaagtatttatgactaagtacttaacagtcatccattgctctaagaacaatattggatgctgttgcttagttgagtgaattctctacataataactaaaataattttattaaaacataaattatttcatgccacacctgtgcttaaatcattctggtggcttcttattgtactggaaaagattctaaacttcttgagagaatatggaaagattctttttagctctctgatatcactctcttgccactctctgccttatagtctaagctgtaatcacactgatcatttacttccttgaacaagccaaggtctttcccagcatagatctttgcaccggccatttcccctgtctagaatgtccatcacctctcttatggctggctccttttaatcttaaatgtaacttcctcagagaggccatccttgaccactaaagcaagtctcttccatactctctaacagcaccctgctgttttatagcatttatcacaatctgtagttaaaatttatttgttcatatttttgttttctattttcactagaccctaaactccatgaaggaaggactacatgtatgtcttatttatggctataaacctagtatctggtacataataagtgctcagtaaatatttgtcaaatgaatgaatagtaagatatccccatttcattgctctgatggcagattttgcctggatacttgagagtgtcagtaacttcacctgttcaaagtcttctttctctgtcaccaaagtcatgtggaaactcactttatctgcttcactagtgtttgctaagctgtttacataagcatctgagtgaatgatgcaggcaagggctgcccagaaatctgaaggtttgtttagaccttggttatcactccaacagaaaagcagaaagaggcagcatatgttgtgaaaagagcttgagtttctgttgatccacttggattcacatgctgccttcattgttttctagctgagtgactttgggcatgttatttactctcctcgagctttagtttcttcatgtacaaacaagcatcataatatctacctttcaaagttgtgagaattaagtaaatgcacagtgcctagaataatttccagcacagagaagatattaataaccataacgattgctatgactgtcagatattggaccaaggatagttttataagtcacatagtctgataaatatggtatgtaacttattctttgcaaggcgcttctttaatttggagcaccacgtatcctaaggacgtagacattttcatttttcttcttttctctcttttctccccactaacttgtttaaggcactcttcatttcttcattcctaagggtatagataatggggttcagcaggggggtgactgcagtgaaaaacacagatactaccttgtcctctgggaggctggtggatgggcgggaatagatgaagatgcagtgtcccaggaacagtgtaactacagtgagatgggctgcacaggtggacagggccttccgcttgcccttggagatctgctgcctcagactcaccaggatgactgcgtaggacaccaccaggaccacaaaacagaccacggagatcaatccactgttggagacaatgaggatctcaatgacgtgggtgtcaatgcaggccagcttgatcacctgaggtacatcacagaagaagttgtcaatctcatcaggaccacagtagggcagcttgatggtaagggaggtgagggctatggagtggatggtccctcctgtccagagggccacagccagcagcacacataccttccagttcatcactatcatgtactgcaggggtttacagatggccacataccgatcataggccatgacggtgaggaggaagatctctgtgcaggcaaagaggtgcaggaagaacatctgggtcacacaggcatcaaaagagatgagcttttcctctgaccacacgtctctcagcatcttggggacagtgacagtggagtggcagacatcaataaaggacaggttgctgaggaagaaatacatgggagtatggagccggtggtcatagataatagttatgacaatgagaacattcccaatcagtgtcaggacataaaaaatgaggaacatggaaaacatagctatccgtgccttatgatttacagataaacctctaagccgaaaatatgtcactaaagaagtttgattgagtaggatggcctcttccattctctttgttagacaacctgtaaagaattagaaaaaaagtctaatataacacagtatctgcatcaatcatttggtcatttaatttcttgtgtgtttatgccttttctctccatctagaatttatggtaaaatatcttgcatttcttttaaaaatccccattaacatcttacatgatgatacacccatagtaggtacttaacatacacttttggaataataaaatagagaatcttcattcattaagagatataaaacaatcttgaagagggagagagagagggaaagaccaaacaagttatttctccattaatgtagtaggatatcaatgtttagatttaggttatggatttttacaggagaagaagttaagattctctttaactcaaatacataatttgttcaaggctacacaaatatggtccctgaacatagcttttttttttaatagtcctgcagactgcacttttcatcaacccaaaccacttgctcagctgttggctttgccatggggctctgagactgtaatttccatgacataactttcagagggcagaagctttgtaccaagctactggacaattggcaacgtggctgtgatgttcttgaacaattgtttagagaaggcaggataaaaccctggaagccttggaaaatgtggaagttgacctctcctccacccctcagctgagggcagacttattcttaaactgggagtcaagatccaagcctaataacattactgtcttgattagatcactctagctcttttcaaagtcccgttctgttgtcttactggcccacaagtgaaataaaaatagttattttcttttaaattagcctatgactcaagcaccactattttttaaaataacgagcatatgcattatagtcacaggattttagcccttaaagggacttgagagttgacataatctatttttttttcattttacaaatagagaaaatgaggcacagagagtcaaatcaactggtccaaggttacacggaactggagtcacagctgggtctagagctcaggtctcccgactcttggttcaggcttcgtccgctctaccaccactctcatctgaatttttgtggtagttggtagaatcagggagtgaagcagaatatgtcttagtggcctctctcttcctctccttggtgtcctgagtcagattgtggggcagggttagggggactatgaggaatctctcttttctagctttcctccttcatgctgctgccctgacacacacagccttccaggggtggcccacccaaggaagctgtctctcttggttgcttgggccccatgatccttgctacttccttcctatcacaagtgactactggagatttatatcatccctcaagatcaggctccctggcagactaatgagtcaaccccacactgcttgtgaaatgtggcaaagaagatatttttggggccagagaagtccttcagttaacacttaaaaattaaactcactgtgtccagtgtttggattaatatttacagcagcatctaaatgtagctattgattgattttactgtttagaaatttttcttcgagtattcgtttgaagcttttgctccaagaagtgattttaagtgttactgatttacacttgttttcatggtcgcaaaattcaaagccgaagagctgaccaagaatggggctaggattttattcagtatgggaaatttcacctgcacagactgaagagggtgtgcagaccaagaactaggtctgaaatgaaggcttctgttctcccctcatagaatatggatatacattttaaactaaactttttccataattatcatttttttctatttctgtggagccacaggaaaaaaatgctttgcaaaatggagatgtgttcaactgcagtagaaagaatatggtgcacaagaagaaaacctagtgttttttgcatacatttcaaggaaatggggaaagatgattaagaacagatataaaatccaactaaaatatctataaaagtcacctgggttgtttctgatgctcttagtacctccaaaagtaacagaagtgtcagtcctgcactttcaatatcaagacttttatcttccagtagaaataacaacttatttgaagttggactagtcagataaccccatttaccttgctttctccaataagaaaggtgagagcccttgaagttccctccttaggtcttgttcacagttttggtgatgtcacagtagatgtatttggcgatattttctggtaaaaggtactatttcaggctgtctgtaaaaatcacacctttgtagctatattattatcatatttttcaatatgtcaaaatatgtaattctgcaccaagattttctaggattggtttccagttaacagaaaatgtagtacagaaataatatatatgttttcacttttccagattgtagtggtgagtagaggagattaaaagccacagtcaagcccgggcaacatggcgaaaccccgtctctacaaaaaatacaaaaaattagctgggcatgttggcttatacctgtggttccagctgctcaggaggctgaggcaggaggatttcttgaacccaggaggtcaaggctgcagtgagccgtgattttaccactgcactccatcctgagcaacacaacgaccctgtccaaaaaaaaaaaaaaaaaaaaagagtcagccacttttgcaggcccttcaggtttattaggacacttctaacacaaaacttgatctaattattcagaaaaccagtgcggcagaagcatcctatttcctttgcagcacactgtttaggtgcaagttttgtattgccagtttcaggtggattattccaccttcaagtactgaaggggaatctgtagagaaagaagcgctggcagctgtagtgttggtgttgttctacctacattatataggctttatgtccttgggaacttttaagcaatgacatcagcttgccctactcactagttaagaaaagttaattctgtggggaatgaagttacagactttgcaataatcaccaagagaattaaatgagaaaagcagtacttaaatacctaaatctttaggatgtatttatatatggttagattaactactatttagtgattgcctactatgtgctaagtattaggtaataggctttcatgttttcttatttaactcatataaaaatacagagatgagagaagggtaatgaagttaagatttttttttttttttgagatggagtctcactctgtcacccaggctagagtacagtggcgcgatctctgctcactgcaggcgccgttccccaggtttacgccattctcctgcctcagcctcctgtgtagctgggactacgggtgcctgctaccttgcccggctaattttttttgtatttttagtagagacggggtttcaccgtgttagccaggatggtcttgatctcctgacctcgtgatccgcctgcctcggccttccaaagtgctggaattacaggcatgagctactgcgcccagccgaggttaagattttagtcagctttctgacagagagattaagtgctttgactctagagcagattgggtgcaaattccaatgtcctacacgtgctaattggagcaagttatttagcttctctggtccttagatttcccatccgtaagcttgaatagtaatagtaaaactttttagaactcttgaaatatttgtaaagcatgtagctcttagcatattaatataattatgttaaatgcaattcaaacaaacaaaaaaacagccgaccatcactaccagtcaacatttttggcttcattttttcattattttggataacagtgaaaatttagaacctcttgttccaattttctttttgctttctctctttagatagatgagcttggtggtttaaattggtgaaacaagactccaaaggagaggtatgaagattatactttcagtttgaatttcaagactgaatagttttgtgggatggttaggatatcttaaataaagggtatggagcataaaataaatcttatagccaactctccatgtgacagtgagtagaagagaagatggtaataagagtgaacatatcagaagttacagaaaatgctttctcctaaggccttgtggcttgggcttcttttccctagttttcttgtttgattcattatcactgatcaaagtccagacttggctgtaatgaagaaggtgtagcttccagaactttacagatattgccacttggtcactgtgggacttctattgtcattgtaatagccttggaaatcaggggacacattaagaacagggatatgctggccatactaattatctgttaaaacaaatgaaatatggcctgagaaggactctgtacttgagtccttgtggatgacctgtaacctagcttaataggcagacaagattgaaaacctaacttaggagtatgcacctgtaacagtagctgagttttggccaatcccagcagccatacttcaaccactcatagtctgctaagtgttcaaactgtgttcaaataaggcaaatgtcaacctggtgcaccaatccagctgtttctatacctcacttctgatttctgtacttcatttccccttttcttttgtctgtaaatcttcttccaccatgtggctgtgctggagtctctctgaatcttgctttgattctgggggctgcctgatttgcgaatgatactttgctcaattaaacttctttaaatttaatttggctgaagcttttcttttaacaaatggtgtcagaagtgggatctgaagtagaccttctaacaacctccaaaattgctgagtcaacaagcaagttacctgatgaacgtatttgtgtcctttgatgtctcagaatggctggggattgtggtaagttctctctcagatttcggagctccacagatttatgttttgagctctccaggtttctttgagcaaatttctgatccaaactgggtttgaaagtcatgacagaaactggacgggttgaggatcaaatttgatctggtaattaactagcttggatccagttagaagcctcttacctctgactgggtcagaaagaaactggtagtaagaggtaatattgcaggggttataaaattttgcttttaaaaattcacaaggatttttgtgttctactcctttgtttcatttttcttgcacacttaggtaggaaagatcattggctaagttaatcaatggaacctagagccacgccaatattttaggtaaaaatgggattctcagtttctgaaaaactgagttccttctagcttatacattatacatacattatacatacatatacattccttccaacttatacattaggcctgggaagcagcaaagtcttagagaaatggtgaaatcttactaaagataatttacagtggaatgttctgaataaacaacaacatagaagtgtatttaaaaataagggctcctccacgtggctcaggcctgtaatcccagcactttgggaggcccaggcgggcggatcacgaggtcaggagatcaagaccagggtgaaaccccgtctctactaaaaatacaaaaaattagccgggcgcagtggcgggcgcatgtagtcccagctactcgggaggctgaggcaggagaatcgcatgaacccgggaggcggagcttgccctcagccgagatcgcaccactgcactccagcccaggcgacagagtaagactctgtctcaaaaaaaaacaaaaaaaaaacaaaaaaagggctcctcaaaattaaatctgctaactgtttagtttagttactatcctgatccaaaggaaacagactgcagcaccaattggctgactttgggtaagtagtggggtacattttacctgagtaaaggatgggattgcattggaggccctcccctcagtaaagtccctcttggttaaaaatggattaaagatgacagggctcaaccaggggcaagtttgagccttgccagttcaatactgcatgctaagcagagtggctaatgtctatgttttgtcacatgtattttgctctgtccagaatgccaaatgttaatttcattaccctatgcaaccccttgggtggcatcctgcaacagtgagaaaattttgcctgtggttccatgattttttgtgtatgtggttggctccctggcactatagtatgtttcagggaaggggaacccaggaacctaacacgctggcaaaagtgtaagaatttcttaccagtcaggtttctggcctctctttccctgtgcttctctttccttgtgcaaactgggaaagttctggcctctctttccctgtgtaaactggttaaatgaatggtaaaaaatcactgtttatcttctgcaaagttttgattaatggaaaaaagtatttatgaggttagtcttaagctgtagcgaatctggtatgtttatgcatcttctgtatcattctttcataaagaggggtaccataggattgaacatgggctttaaaccccataagcccactgctcaagatggcccagcaagctggtcagtaacaaactttgctgcaggatcctgaaacaaacaaaaaaactggataaggtctccatattgttttatgtctttgggagcttgaccttgtgaccatatggtggtactttctcttgctctctgccttccagggaaaaggaattttagggttcatgtcatagttacctctaaaaattatcttgagtagttaaaagcctttgcaagctcaaaattaactactctagactccttctgggatgggcagtggagacttcccagtgctgtagctcagtagctaagattttgttctttcacagtggtggcttggattcaatcctggcttaggaaatgcatactttctggttgatatctgtgtgacctttatcatttgttaattctcttcctctccatgaacaacttctgacttcccttcttgaattttcctttctttgagctacctttgaagattctagattttgtaaaaactgcatgttttcctagccctgtttcttgaagggctctgccctaaggccagaattaagaaactggcaaataaaacatctaataactactggatcttcttctgtctgtgtatttatgtatgtgttgtgtgtatgatgtttatataaaagatctctaattaattggcataaaaataagctcttaaatcaaatattttgaaagaaagataaaaatcctaatgtcttttagctcatgtaactttagtaatctttgggaaataaaaacagctttaaagattattggtaaaataaagacatttggtctaaattaggcaggtcagatattaggtttattaaatgctttaaggtcatgaactgttttgacttttgaaaattgttcaatttacctaccttgaagacactagattctagataagccctggggacatgtggaattagcaatgccccttagccatgcaaagaaggttataaagaaaagatatttttatataagaaagaatactgtatgttaaattcttatcctaaagtaaaataatggttatttaaaaagagagatgtttaggacaagtcagaaagtccaagcacactgtagatgaaagtctgtgtaagtcatgaaaggattcgtgaaaggaaatctgtgcaccaaaagcaaaagttgctgagttaccattataagatgtgattgagattactgaaaaaaatagttttacgtgcagggtatgtgaggatagtaaaatgtgtttttggcaaaagattataagaaggcatgggaatgtaaatttttgcctagtttagagggttaaaggattgttttaaattatgttagaataagctaaaagcttgaacaaggtgtagaagggttgtaaaaattaatcttgtaaaagaaattctgtgtgtgaacatattgactaaatttaaaaggggattatttgttttttctgtaaattgaacatcaaaataaaagcacaaacaggggtttcttaaagcactcatctgctctttaacaaaaatttgtaaagggttataaaaggtttatcggaatctcaccttatggtcaaactgatgaagactggttagatttgtctatagacaaatagacaatagatagattataatctatccaaattatatataatttgttttattaagaattgggtttgacattaataatatactaatgcaagggtaaaatttggctttctctcttgaacaagattttcatgtaatattaaaggataatgaaagatttttctttgccttttgagtaaactactgaaaaaacggaaagacaacagaccaattggaaagctaagtctgtcctttatcaatgagtaaaggtttttgtcttttgaaaacttcgagtcatcattttggctaaatgaatgacttatggtaatctggaatactagttcataatattaagtgttttaaacctttaacatatttaataggcttctcaaaatcaaatttcagcttcaaaattgtcttttctgacctctaattttgagatgatacagagggctcttgaagcatctaaaagagagataaacaggattatttgacatgtttagttacatgggatcgtcaaaataaaaacaatgtttaatcttcttcaggttatattttcatgaataataataatatattccaaaattttatgcatttctaaaattctgatatgtctgagtatatgctatcaatcataattatggttattgttattatagatcacagaaataaccacatttccttgtctgttctgtctttacagctatttaaagtcacttccacaggtaattgcataatgctgatgcaatttctaaaaatttcacaagcacataaaatcctaaaatatgatgtcttttaggagattcatgaaaggatggaaaggaccctgaaaagtgctcttgaatataggtttctaataactttaaaatcacatcgtgggtaaaattccccaatttccccagaattggaccgggtaagaattcctgaaactttaataaaaagactgattggtttataaaactgcttaccccagtagaacaaaaattaattaaataccgagaaaatactttgccaggttttcatgctaactcagccaatattaaaattgttgagacatacaatttgaatgaactccatgctctaactgaaattacctatgacaacccgtcagttatcagtgttatgcacctaagtcagagaaacaactggtattcaagaggacataagtctagtgttaagcatggactcatggagaaccaggaaggctgccttgtccttcctgagtccttaaagcttttgttattaaaggttctgcatttcatgactcatcatggaaaagataaaattatccacattacatgcatactggtgtggtgacttatacattgctaaattagtttgtaaccagtatttggtttgttaaatccatattcttgggaagacaaccaaagcttcaggtacacttggctacccgatgggccatttaaacatttataaagggatttcattcaattgccattttcaacgcatgttttctgtttgtataaaagctttcccatgcaagagggctgatgttataacagtagattattacgctacagtgtattttcacctggtaaagaaaggtttttatgattccctgaggacaatcagcccctacacaatctagaacccaaagattggatcttctgagaacatcagagaaagactgtccttgacatccacactatagcaaaactttggaactttgaactttgggttcgtaatctcacaactgagaagggtccctccacactcttggaactgtacatccattggaacccttaaggtaaagctaaccagggaaatttctccccagaagaagatgccatccttgatataaacagcttttcccaagatcacagatcaagacttctactattatgagactcttatctttgaatactttttccttgtttatgcctctgtgaacaatagaaatggaaagggggtctgttgtgtgcacttatatggtatacttttattcataaatgattttgcagccagccttacacatgaataaccttatacctttacagataaaaaaatgaaagcccattgtagttgagaaactttaaaggtagaaatattgccatgtaatcagtcagaaacagaacatggattcactcctcttaacccacatcgtgggctaaagagaatgttgctaggaggtcttcactcttcccaaaggcatcatttgttaggtcatttttctgtggtttgaagtaaaagaggcaatgattagaaatgtatccctcatgataggcactatagcagattctactgcaaagactatgcttacacaacagactttaaagtctcttgtgacagttatgctaaacagtagaattggctaaacagagaagaatctgtgcagtgctagcacttgtggcctaggaagaaatacattgggtattatagagattcagttgtaggggattaacaaaaagatcacttagttaagcaagtggactctttatctagctcattctttgatctatttgattttaggtggtttggtttatggggaacctgggtaaggagcatactccaaactcttggtattatcctcccaatagttaccacagtagtctctctggtgcactatattctcttgaaggttttaaatgtttgcatgcagccatctctagaatgtcaaatggtctctcttcaactggaatgacaaaagctgaagtaaacatgtgaccatgaggacaccgtaaactatgaaggacatgctgataccagaaacccaaaatgatggtaactgagagtggcactaaggccttaagtttggttacgctctcacctaagtgagaacctggccaaaaagggggaattttttagaacaaaattatgggaggccattgtattggactaagatcatgcactagaccccaacagaccaaaccaaaccaaaacggagttgcttatgctaaatttgacgtaatgaaactaagactttaaggaaacacataaattctagaacagaccaggttttgtttttctcctgaaaacagaatatttcagcatagggaggtacccactcagtccttattctctccttggaaaactcattcttctactgtttcccagcgggtttgaagaccaaataagtacatttatgatggtgatcatgacattaatgactaaagttttggtcaatctctcaaaattgagaaaatgaccaaaagtggggaattgttaaagcaagctaaatatagcctgagaaagactacatacttctatatttgagttttgtggatgaactgtaacctagcttaattgaaaaccttgcttaggagtatgtgcctgtaacaatagctgagtcttggccaatcccagtggccatacttcaaccactcaaagactgcaaagtgttcaaactctgttcaaataaggcaaatgccaacctgtaaccaatctaactgtttctatacctcactcctgacttatgtacttcattttctttttttttttcatctataaatcttcttccaccacaaggctgcactggagtctgtctgaatctgctgtgattctgggggctgcccaatttgtgaatcactcatttctcaattaaactcctttggctgaaatttttcttttaacacctctgtacttttggaatagaagtactttatcataggcatgatatatcaagggcaatacagaaaatgatattcagttgatcgtaaggcaattactctcaccacttttttagtaaaatgcaagattgagaattaatctttgactgtcttatatcacagttccctgctttcccccaagcccttggtggcctttctccttggcccatgacttttttctgactatacacagatggcctctgaggtgtcccactaaggcttttcctccctgaaagtatgtccctcttattccaaaatgtattccacagaataaatgaaaacagtggtttacacttgcatagcactttagagtttacaaagctccttctcactcattattttatttgctttttataacactcctgtgaggtagggagcactatggaaaaattggattggtgttaagtgattttcacagagtttacatgccaggttagctcccgaaccagggcttaaactcagtcttctggtgccaagtccagtgtttactccattacttcacttggatgctgcatattataaaggagaaatagcttcaagatatgaatgattggttaacctcaccttctatggaagatgcacacttaaaagaattgcttgttaaatcatatagaaatttttcattggtgtaggagagagagcagttttttaattattaactgacattttccttcttcccattctactctttccattccaaaagatcagtgatatggtcttcactgctgaaaggtcactgactcactactaaaagtaatcaatcagcagccaataacctaggatgtgtacaatatcatacttactgtagtatgagataaaaaggctcataagagtaatgatcctttcctatgaggaatttataacacagtgaattaagatgacatttattttaggagttgaaggaaaccccttgaaaaaaactttggggtgatatctgtaaacgcaatatgaattaaatgtgttgtgaccttccgtctgagcccttccatcccccacagaagaaggtaagaaatcaacagagcttgcatgcccctggtgggaccatcattctgtttttcacaataaactgctgaaaccagaccttaagaggaagctacaattagatctcatcacctacccacctgctttcaaaagagaccaatcaggttaattccctcaagctatgtatgcctgtttattccagtgttcacaacatctttgaaccttcagatcacccttatggactcttatgtccataaagcttggtactttctgtagtctaacttttatccttttcagaccctgcacacactcttcattatgtactctggctagcattttgcaagcagaatcccttatgacctccactgttttttttttttttttgcacattacctttatattactgcagtcctgttaagcagtgcagggtttttctgctatgctgggtctcaagttttggtaagtgccatttttgttttttcaaaaccatgctgattcagataatttctctttcttcctttgtagaaatttctatgcttcgaagaaaattttaacagactgttccaactgcaaccctttcttgttttatcttcaatgatcctctcagccactcaccctccctcctcaaatattttgccaattataatcatctgcacagatgaccattcaatactttggcctcagttatttagcctcttctacagtaatttcaccctccaaccctaactcagccattcccatgaacatgctcctgaattttcagtatcaataacagcaacccatccatgctgtttcaagtattctactttctgatcaccaacttttaacctttcctgttcattccttctagtactcccaattatacattttttcaaacctgccagaaacaccaatccattgatcctatcatcctctcactatcctttattcctctcagattgttactccttccttatccaacttaaactccaaggtgtaagtttataataatacctttgcatacaccttctactcatttgttcatctgccccatccactggaggtttttccaggaattatgttcaatgcaatgcccatttttggggtatgcctgagctgatgaaggaaaacacacaacaagatagaaggtcttacaattgtgaccacaacctcaaataggcagttctgcattttctgtagtcaatttacatttttactctccgtggtaattgttttatacagagtttactcaaatctttagcaaatccttctaacttttagattcagctaaagaaccgcttactattttaataaaaaaagtaatcagaagagaagttttaccccatcccactgctaactacatccaccagtctgcatctgaaactgcaaactctgcctattcttataatgggcattctgctctatctaaggccaacccctccatttgtacccgggatcccagcctttcttgcctctcaaggactttgctcgagcaactgtgtctctagcatcatcacatttcggtcactgttgaagcattcccatcagcacacaaatatgctgtaataatttcaatattaaaaaaaattccttgacatcacatttttcttcaacgggccacctattttctctgcttttctttatagctgcattccttgacagaattacctatactaatagtttccacttcatctgctaccatttgtttattgaacctactctgatctgactttgtgtctcaatgactccgctagaatagttctcacctagatcaccagtgacatccatacttccaaattcaatgggcagttcttggtccttgtctcatttgacctttcagcatcatttaacatggtcaactttttttttgtttaaatttttattttttaaattaaattaaaaaaattttttttttttttaggctgggtgtggtggctcatgcctgtaatcccagcactttgggaggcagaggcaggtggatcacctgaggtcaggagttcgagaacagcctggccaacatggcaaaaccctgtatctactaaaaatacaaaaattagccaggcatagtggtgcatgcctgtagtcctagctacttgggaggctgaggcaggagaatcgcttgaacccgggaggcagaggttgcagtgagccgagctagtgccattgcactccagctggggtgacagagtgagactctgtctcaaaaaaaaagagaacagattttttttagagtcagggtcttgctctattgcctaagctggagtggtgtgctgcctttgcctctctagaaggtaggactatagttgtgcatgaccacgcccagctgattaattttttttttgtagagataagggtcgcactagggactactggagatagccaccatgcctggctctttctcttttttgaaagaggacacttcactctcctattccccctgccccaatttcctggttgctcccttaaactctcctttatagtaccctctttctcttcatgacctctaaatgaaatgcctcaaggatcagtcctcagatttttcttttctctgtttatgctttctaagtgaacccatccaagctaattattttaatgccatctttgtgctgatcgccggaatttttatctatagccctaacttctctgagccatagttttgtatattcttttgtggcctacttaacgtctctacttggatttctaaagagtatccaaagtttaaaagcaatctaaaacaaaactcttctttgcatgctatctgaaagtgataactccattgtcctccccatttttgtaacagcattaccattcatccaactactaaacaagacattctgaattcatctttatcttctctctggtatcccacagtcagccattcatcagcaaatacaaatagctctgcacttaaagtatattctgaacctcaccacttctcagccataatcaaaggcaccattatcgcactttgactactgcaacagcttcttatctatttctctatttcaactcttgccttcctcttagatcctgctctccaatcagcaatctgattcattcttcagaatgaatcatgtgtctgtttgtactcaaaagtaatcacttccctctatcctttcttgttcattaaactctaaccacactgaattccttgtgtttcttgagcacactaaacatcctctcctcgcatgacctttgaactaactattccctttgtctagaatagtttttcaccttatagtacctggttctctgcttcattttcttcaggtctttggtgcaatgtcaccacttgagagaggacttctttgagagaggttgccaaaaagaacactccaaatctaattctgctgtcaatgacctccaaccaatcacaattagaagcaaacctgtagtcaaactaagttgggtttgttgactccttgtaatgagggagaccatggaagttccagtaagtaagaggattttagaaagaacatatagggtttgggtttttgttaggtgataatgggaaaggttcaaggaagcaggcttttctttcaaatgactattgttaggaagtaagagtaattctatagttggatatcttgataattctcctctagaaggcagtaagaatgcagaaaatgaaaattttaatgggttaaaaaagcaacgatcactcatataaccgggatagggaactatttggttatttttatggtttggacatggtcttctttttgtctgtgttaagacatgaatatggaatagtcttatttttgaaaatggaatagtcttgctccattatggtactgagtagtcttgtcagatattggtgttcagagaagctgtttagtaggagatcatcaagtcctaactatgagtgctggactagctcctagccacaccaaggcctatgtgatagtgccaggccattttctagttatcaggggtagcttttctccttcatagtcctctcttttggctgaaagcagactaggacaggccacaggacattaatctataatatccatacagtgttttcatcattgtcaaaactatgtcggttaggaggttgtctagagaatgttgtctgtagtgggactaggattggtctctctgttctttttgctgcaaaacaaattgttgaatccctttgacatgacaataaatttgaggtagcatttaagaatatggaaagtgtacattagctatattaactgcagtgcaggcaattaccagtaacacaatggttattagttcttctttttttttttttattatgctttaagttctgggatacatgtgcagaacgtgcaggtttgttacataggtgtacacgtgccatggtgatttgctgcacccatcaacccgtcatctacattaggtatttcccctaatgctatcccttccctaaaccgccaacccctgagaggccccagtgtgtgatgttccccccgctgtgtccatgtgttttcattgttcacctcccacttatgagtgagaacatgcagtgtttggtttctgttcctgtgttagtttgctgagaatgatggtttccagcttcatccatgtccctgcaaagcacattaactcgtccttttttatggctgcatagtattccatggtgtatatgtaccacattttccttatccagtttatcactgatgggcatttgggttggttccaagtctttgctattgaccagtgctgcaataaacatatgtgtgcatgtgtctttatagtagaatgatttataatcctttgggtatatacccagtaatgggattgctgggtcaaatggtatttctggtgctagatccttgatgaattgccacactgtcttccacaatggttgaactaatttacgctcccaccaacagtgtaaaagcatttctgtttctccacatcctctccagcatctgttgtttcctgactttttaatggttgtcattctaactggcgtgagatggtatctcattttagttttgatttgcattaccctaatgaccagtgatgatgaggtttttttcatatgtttcttggctacataaatgtcttcttttgagaagtgtctgttcatattctttgcctgctttttgatgggattgtttttttttcttgtaaatttgttgaagttctttgtagatttattagccctttgtcagacggatagattgcaaaaattttctcccattctgtaggttgcctgttcactctgatgatagtttctttagtggcgcagaagctctttagtttaattaaatcctatttgtcaattttgccttttgttgccattgcttttggtgttttagtcatgaagtctttgtccatgcctatgtcttgaatggtattgcccaggttttcttctagggtttttatgtttttaggtcttacgtttaagtctttaatccatcttgagttaatttttgtataagatgtaaggaaggggtccagttttacttttccgtatatagctagccagttttcccaacatcatttattaaacagggagtcctttctccattgcttgttttttgtcagatttgttaaagatcagatggttgtagatgtgtggtgttatttctgaggcctctgttctgttccattggtctatatatctgttttggtgccagtaccatgctgttttggttactgtagccttgtagtataatttgaaatcaggtagcatgatgcctccagctttgttctttttgcttaggattgtcttggctatagaggttctttttttggttccatatgaaatttaaagtagttttttctaattctgtgaagaaagtcagtgatagcttgatgaggatagcattgaatctataaattactttgggcagtatggccattttcactatattgattcttcctatccatgaacatgaaatgtttttccatttgtttgtgtcctctcttatttccttgagcagtggtttgtagttctccttgaagaggtccttcacgtcccttgtaagttgtgttcttaggtatttcattctctttgtagcagttgtgaataggagttcactcatgatttggctattattagtgtataggaatgcttgtgatttttgcaccttgattttgtatcctgagactttgctgaagttgcttctcagcttaaggagattttgggctgagacgatggggttttctaaatataaaatcatgtcatctgcaaacagagacaatttgacttcctctcttcctatttgaataccctttatttctttctcttgcctgatttccctggccagaacttccaatactatgttgaacaggagtggtgagagagggcatccctgtcttgtgccggttttcaaagggaatgtttccagtttttgcctattcagtatgatattggctgtgggtttgtcataaagagctcttattattttgaggtacgttccatcaatacctagcgagatcaacgcagaaggcgagtgatttctgcatttccagctgaggtacccagctcatctccttgggactggttagacagtgggggcagcccacagagggcaagctgaagcagggtggggtgtgtcacccgggaagcgtaaggggtcggggaactccctcccctagccaagggaagccgtgagggaccgtgcagttaggaacggtgcccagatactaggctttttccaaaaccagcaggatgaagatagggaagattatcttgatgcatcttttagttaggtaataaaggaggttagattagtggcagatcaaaatgaaagaaagagggctgagaaatcagaaaattaatcttgttttgtggtcttgggtgaaagctatccacttctgtagtcatcagcttgtagagaatttttaagaatccttaactcggggtcttccaagtgcatggatttccaggctttgtaagaaatagatgtatctttttagttagaaagcctaactcccattactgggtatatacacacccaaagaaaaataaatcattttaccaaaggacacctgcacttgcgtgtttatcgcagcatattcaaaatagcaaagacatggaatcaacctaggtgtccaacaattgtgtgctggatagagaaaatgtggtacatagatacaatggaatactacatagccataaaatagcataaaattatatcctttgcagcaacgaaggatgaagatggaggccattattttaagcgaattaacacagaaacaaaaaaccaaatactgcatgttctcacttataagtgggagttaaaccttgagtactcacagaagatgagaacaacaaatactggggaatccaaaagtcaggagggaggaaagggggaaagggctgaaaaaaaaacttcctgttggatactatgttcactatctgaatgatgacatcaatagaagcccaaaccccagcatcgtggaatatgcccttgtaataaagctgcacatgcacccctgaatctaaaataaaagtaaaaaataaaaaagcgtgactccaacgaccaacaccttgaagttttactgttgtgtcagttgttaataatccctgccaaggttcttttcactggggctgaagggctgtttctctctgacgtattttctagaagactagatctccctatttcagatcagacagtgggtgttttaaaaatgtagtttgaacctgtttgtgttaaagctggcagcatcatatgtgtctcatgtgatatttggtcacattaacctgtagtatggcataatctaggtttagaagtaaaattttcaaatgaactgggtagcttattattagctcatacggagatcacctgtgggtcccagagaaggtagatctcattgtcatgaaggctaatagaagtctgagtacttttgagaactatgccaattttagttttagaatttcattagttctttttacttttcttgatgtttgtagacggtaaagatagtgaagtcttaagtaaaagatacaggtttacagagttatttggtaatagtataagtgaattatatgcccctattactagaaagataagttaaaatttcccatattggagaaaaagaaattaaacattctggtcacaactgggccatagctctttgtcaaggacaagcatcaactcatcacaagagtaaataataaccagaacatatttatagtccattgctggggcatttatataaaatccattcagaggtgatcaaagtggccttgagcctttggttcctatcaatatcctacttttgcaatcctcccagaataatctcatcagaaagtagggcatgcatagaaaatgtctttggcaatattcctaaaattgttccaccatgttggttaaatattattgtcaatgcatctttattattttggataatattgtgaagcatttttgttaaatgcacttttattatggctatatccttaggtaatatcaaattgtctaaaagtttattaattctcctttcattttatagggattcctaaagagatgaggaaatttgcttgttttcaaagcattttaaaataatagactaactcaaaattatatctactatcaatataaatgtttgtttctttactgtttttcctctggcaggtccaggcaagggcaatgaatttaactctccaagctgatttagtttctgggagaagcttaattttcaagagtaaattcaagctcttgaattaaagctcttgagatagcataaccttctttgcaattttcagtttttaaaaaataataaactattatgtaatattgaatcaagaatatttaagggagtctctaggtctgtgcaaggtatgagctgttgtctaatttaagtaagcagtcatgggcttttcctttgggtcatgtaaggaaggtgactggggttagagcgttaaagtaatagacagtgatgtgtaagtgttaaagtaatggacagtgacgtgtaagggcaaagaaacaataattcataagaagtttggctaatagctaagaagcttgagggatttttgtcatttgcagggtctgtaaagtgtaaggaatcattaaggtcggtgtaaatcctagaactaaattaactgaagactctcattgctgatataggttttaggcaaggtgatgtatcttgactattgtaccataaaaaagactgaaattagcaataaacttctgaggattcctctatatttgagtcagtattcctagtgcttgtccagccctctcataaacaaaaggaaaaaggggtttgtggatttagaaaactggaagcaaggttgtttttttttttgttttcagatagttgtatcactctttgggcctaaataaaaatattctgcctttaactggaaaagaagagttttagatggagaagaaccaattagctgcctcctataaggagtctcttatgtgaaacaggaataagactataataatctccaataagaaaagataatgggactagaagctaaagttttaaaacaatataatttttttttttttttttactagttagaggtattcaaggatggaacaatttcttcattagaaatgaggaagaatagggtcgggcatggtggctcacgcctgtaatcctagcactttgggaagccgaggtgagcggatcacctgaggtcaggagttcgagaccagcctgaccaacatggagaaaccccatccctactaaaaatacaaaattagccgggcatggtggcgcatgcctgtaatcctaactagtcgggaggctgaggcaggagaatcgcttgaacctgggaggcggaggttgcagtgagccgatatcgtgccattgcactccggcctggacaacaagaggcagattctgtctcaaaaaaaaaaaaaaaaaagaaataaggaagactagtaaaaatttcaatcaaagcctggactatcatttgtttgaaataagaattcaaatattatttggatggctagaataaattattcaggctatttagaccaaaccattatatgagtgcacaaaaggctccagttgtaaggaacaggtgaatattctgaaaagaagggcaattcctgtgcttcaaaagccaatcatgtatatttatggttttgttttgttataaactcaagagaaagagatgaacaaaagtggttggtggctttccaatagggttaagaggaaaagagggaactaatatttatcgcatgtttacaatgtgccagtaaaataaaagggagatgctggaatttttttttttaaattcccaatttctatacagcagtatatagtttatcaatagcaaagaaagacaatttgaaaaagtaatggttattgttaaacctgctttattttccaccaagtcttggcaggatgagattcaggattagaacagaaggtttaccttgttcataagatacatctaaatgaaggtgtgggaggggagggctagaactgcatgttaagaagtatgtaagtgtatggaaacccataaagttaagagttgaagtgtatgggagtgaatttggatgagatttctttagagcaaaataaacattttttcttaataaatactacaggttgcttaatcagaatgacaaaacaggtaaagaggcaaggtggtcatgatggtgtggtattaatttcataaagctatctgttgctttggaggcatgggccccagtcttagcatacctgagcttgagttctagtatttgcattttatccttttcattactgacaaaatgagaattaatcaaacttattttaattattcaaagtaatgaaatgtatgtgaaaagcctttgtaaggtgtaagacactatgaagtgtttgttttggtaacaatgaagttatccagtaagagtcttattctgctagtcatggatatgcatgggcaacaatgtctgcctccccagattccagtcactcctctctattgtgttgcatcatgaagcttgagaggaatggattgattgattggtcccattccctaacccatatctcaataaagtcattggactgtaacccatatctcaatagagtcattgagatatattgcattaagccatgcctgaagccctattttctctctgggcattctagttttatgagccaataaatccccttcagcttgagttgaaatttttgtttcttgcaattgaaacaatcttgattgatgaaacatttaataaattttgactcactgacagttttatggaaaagaatgtaatggagaccaggaagaatactgttactctggatttaattctgattgataggaaagaacttgttaatgacatgtatggtaggttaaatgaaagtagctttggagtcaaatatatttgggtctaagccctcattccagcatttgttatcagtgttactttaagcaaataacttaatgcctttcagctttagtttcctcatctataagttgggtgtaataataatgtctatatcatcggagtggtaattaggattaatagataattaatagataacgcacataaaatatgccatagcacatattaaggattcaacagggattaggtttgaaaaactagaaatggaagatgcagaataaagacttaactgcccattattgccctatctctaaaataaactgaagacaataaggaaaatgaatgagaaagggagaaacatcatctttttaaattaaaaggcaacactttaagtgtgaaaatacactaattagaagagctaatgagtgtatctgaaattagatcagggtaaaggaagatgccaggagaggatgactacattatagagtttggacagagtcagcacagcatagatttctccataggggccaatgggtagctgtactttggaacataatcatgaaaggctgtaagtctctgtaacctccttgctgttacagtgtaacagaagaggcaaggttgaatgaggaaaccttaaacatactatctttggaacaacgctaattatgaagaagaatctgtgtatgacaagcaactctacagctatttacctttgttaaccaatgaagagagaaggtcaaatcaccttgcaatctcacagacacaaaatatgtactatgtagggcttcactgtgagctagagggtatccttattggcctagaacattcttctgaagccttatgcacactatcttcctaaaaataacttaaccaagaagaaatcacttaatttaaagagaaatattatttaaaaagcaacagaggatttatataaaacactacaatctgaaaatgaaataagaaaacaattttatttacaatagaatacaaaatacttaggagtatatttaatcaaggaggtataaaatttgtacaccacaaactataaaacattgctgaaagaaattaaagaaggccttaataactgtaaagacattctgtgttcatgcattggaagacttaatattgttaaaatagcaaactactccaaatggttgacagactcaatgcaatttctaccaaaatcctaataccctgttttttttttttgtttgtttgttttgcagaaactgaaaagctgattttaaaattcacatggaattgcaagggatccagaatggccaaaataatcttgaaaaagaaaaataaggtgggaagactcacatttttatatttcaaaacttactacaagctgtggtaacaaaggcattatgctaatggcataaggatagacatacagatcaataaaatagactgagagcccagaaataaacccaataatgataagcccaagaaacaagctcaatagaatagattgagagtccagttaattttcaacaaaggtgccaagacatttcaatggaggacagaatgatctacttgacaaatggtgctggggcaactggatatccatatgcaaaagaatgaagttagacctctatctcataccatatgaaaaaattaactcaaagtggatcaaatatctaaattagaaactaaactataaaactcttagaagaaaacacaagagtaaatctttatgaccttggacttggcactagattcctagaaatggcacccaaaacacaagcaatacaaggtaaagtagatacattggacttcttcaaaattaataacatttgtttgtaaaaggacatatcaagaaagtaagaagcaaatctaaaggatgggagaaaatatttatgaataatttatctgataagggtctagtatctagaataaagcactcttacagcccaaccccaaatagacaaacaacctgattaaaaattggcaaaagacttgaatagacatttttacaaagaagatgtacaaatggctgacaaacatataaaaatatactcaacatttttagtcatcaggaaattacaaattataccacttcacactcaactaggatggctgtaatttagaaaaaattaaaataagtgctggtgagaatgtggagaaattggaaacctcatcaattgctggtgggaatgtaaaatggtgcggccattgtagaaaacagtttggctattcctcaaaagttaaatatagaattataatatgatctaaaaattccaatcctagatatataacctaaagaattgaagaaaggtattctaataaattattatatatgaatgtttatagtagcattattcacaacagccaaaagatggaaacaagccaaatgtccatcagtgaatgaataaacaaaatgtgatatagctacaaattgttattattcagccataaaaacaaatgaagttctgattgaccttcaaaagctttatgctgccctctccctctccctctcccctttgcacggtctccctctgatgccgagcggaggctggactgtactgccgccatctcggctcactgcaacctccctgcctgattctcctgccttagcctgcccagtgcctgggattgcaggtgcacgccaccacgcctgactggtttttgtattttttcgtggagacggggttttgcagtgttggccgggctggtctccagctcctgaccgcgagtgatctgccagcctcggcctcccgaggtgccgggattgcagacggagtctcgctcactcagtgctcaatgttgcccaggctggagtgcagtggcgtgatcttggctcgctacaatctccacctcccagccgcctgccttggcctcccaaagtgccgagattgcagcctctgccccgccgccaccccgtctaggaagtgaggagcgtctctgcccggccgcccatcgtctgggatgtgaggagcccctctgcccggccgcccagtctgggatgtgaggagcgcctctgccgtgcagcgaccccgtctgggaactgaggagtgtctctgccctgccgccaccccgtctgggaggtgaggagcatctctgaccggccgccccgtctgggaagtgaggagcgtctccgcctggcagctgccccgtcagggaggtggggggcagcccccgcccagccgccgccccgtctgggagttgcgggggcgcctctgcccggcgccccgtctgggaagtgaggagcccctctgcccggccgccaccccgtctgggaggtgtacccaacagctcatcgagaacgggccatgatgacgatggcggttttgtcgaatagaaaggggggaagtgtggggaaaagaaagagagattggattgttcctgtgtctgtgtggaaagaagtagacataggagactccattttgttctgtactaagaaaaattcttctgccttgggatgctgttaatctataaccttgcccccaaccccgtgctctctgaaacaggtgctgtgtccactcagggttaaatggattaagggcggtgcaagatgtgctttgttaaacagatgcttgaaggcagcatgctggttaagagtcatcaccactccctaatctcaagtacccaggggcacaaacactgcggaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaaaaaaaaaaaaaaaaaaagaagaaatagaatagaataatataagtaagttacatgtgttcctctaatttgtgttcatccaggggaggcaaaggatggcaacaggccaaatccagcctgccacatggttttataaatacagttttattgaacacagcctcgcccattcatttacttatggtctatggctgcttttttgcttcacaatggcagtgttgagtaactgcagcagagaccacacggactgcaaaacctaaaatatttactatttgaccttttactgaaaaaagtttgctgacccctgatctattcatcataaacttctttttgataaatggattctaacagagacaaagaacttagggcttaccatcaaaacctttgaagttctgcctggttctgtatgtggaggctctcatggtgttatcattgcactcttttaccaatcccactgcttctgtccccagtaacattctaatcttggaggcaccaacaagatataagttctgattttctagtgtttcttgttcatatttatttaacaatggtctaaacaacaactgggcaccttcaaaaacaaaagataagcacaatcttagacaaacattaaagtttcaaaaataaaaactttctaaataaataaaaaaaaaagctttatgctaagttaaagaaaccagacataaaataccacctgttgtatgattctttttatattgaacatccagaataggtaaatttgtagtcagaaagtagactagtgtttacgaggggatgaggagaagtggagaacgactgtttaataggtatagaattttctcacagttagtgttgttgcaaagatagtatgtttaaccttacctggagctgagacaaatttaaagagccgagcgaaatacaggggtggaagaagcagtgggaagagccctgtgggtaatctcagtccccagggaagccatttgtgacttttttccacagaggtccttggggagggctgccagaggaactgggaaaagaccacagggaggaggaaacatccagctgaactttgtaacagttttgactgaactcaaagtttcctagacagaactcaggggagggagaaattgagagcacagacacagcacagaagcctaagcaggtgggaaggtatgaaacctgaaagccccgcttgctttctcagccaggaggctggtagcctggggcaagttctcagctctgctcaccctctgcctggaaataaacttggtcctgctagcggggcaccaaaagcagttggtgctgttggtgggggcaccaaaaggctgggagttagaccagccttttgggctttgtgggagctgggttaggccagtaactgctggctttcccccacttccctggtgacctgtatgacccagtagaggcagccataatccccctgggaacacaacttcattgccctcagaaccacactcccatctcccacagcagccttagcaagcctcgcgcaaggacagtctgagttcagacttgcctaaccctgcccccacctgatggtctttctctacatgccctggtagctgtagacaaaggacatattctctcaggagctctaggaccctgctcattgcctgaccctcacagagtccatttcacccccctactgctacctccaccggagcaggtgctgctatccatggctgagactccagacaatggttcacatcacaagactctgtgcagacactcccctgcccctgccccaagtaccagcccagagcccagtggcactactgggtggttagacccagaagagaaataatgatcactacagtttggttcccaggaagtgacatccccatgggaagggagatagcacacatcaagggagcataccatgggacaaataaatctgaatatcagcccttgagctccagattttctctctgacatagtctacccaaatgagaaggaaccagaaaaacaattctggtaatacgacaaaaacaaggttaacacccccaaaagatcacactggatcactagcaatggatccaaaccaagatgaaatccctgaattgccagaaaaataattcagaaggttgattattaagctaatcaaggaggcgccagagaaaggtgaggtccaacttagtgaaatgaaaaaaagatataagatatgaaagagaaaatattcagtgaaatagataacataaataaagaacaatcacaacttctggaaacgaaaaggcacacttagagaaatgcaaaatgcactggaaagtctcagcaatggagttgaacaggcagaggaaaaagctttggaactcaaagacaaggctttcaaattaacacaatccaacaaagacaaagaaaaaagaataaaaaaaatttaacaaagcctccaagaagtctgggattatattacatgaccaaacctaagaataattggtgttcgtgaggaagaagagaaatcaaaagtttggaaaacatatttgagtgaataatcaagaaaaacttctacagccttcctagagatctagacatccaaatacaagaagctcaaagaacacctgctaaatttattgcaaaaaagattatctccaggcacataggcatcacattatgtaaagttaagatgaaggaaagaatcttaagagttgtgaggcaaaagcaccaggtaacctataaaggaaaacctatcagattaataatagatttctcgcagaaaccctacaagctagaagagattggggccctatcttcagggtccttaaacaaaacaattatcagcaaaggatttttgtatccagtgaaactaactttcataaataaaggaaagatacagtctttttcagacaaataaatgctgaaagagtttaccactaccaagccagcactacaagaactgctaaaaggacctctaaatcttgaaacgaatccttgaaatacaccaaaatagaacctctttaaagcataaatcttacaggacctataaaacaaaaacacaataaaaaaccaaggtattcatgcaacaaatggcatgatgagtagaatagtaccttatatctcaatactaacattgaatgtaaatggcctaagtgttccgcttaaaagatgcagaatggcagaatggataaaaattcaccagccaagtatctactgtcttcaagacactcacgtgacacaaaaagactcacataagcttaaggtaaaggggtggaaaaagatattccatgcaaatgatgctaaagcaggagtagctattcttatatcaaataaaaaactttaaagcaacagcagttaaaaaagacaaagagggacattatataaagatgaaagaattgtccaataggaaaatatcacaatcctaaatatatatgcacctaacactggagctcccaaatttatgaaacagttactactagacctaaaagatgagacagacaacaacacagtaacagcaggggacttcaatccttcactgacagcactagacaggttatcaagacagaaaatcaacaaagaaaaatgcatttaagctatgtcctagaataaatgggcttaacaggtatttacagaatattctacccaacaactgcagaatatacattctatttatcagtacatggagcattgtccaggagaggccatatgataggcctcaaaaacaagtctcaataaatttaagaaaactgaaattatatgaagtattttttatgtaataattacataattttatgtaattttatgtcttgggtttccacacttactatcttatggaacctgttcccttgaaggtcaccagtgacctcataatggttattttagaaagcctttccccccccataatggcctttttagggtatagctatcatgcaataaattgaatatatttaaagtacacagtttgataaattgtgacatatgtatacacccatgacgccatcaccacaatcaaattgattaacataaccatcaatcacaaaagtttttttgtgccctctcatgatcctgtttttctctttttgcccccgtcttcctttcccaagcaaacatgaatgcactttctgtcactgtagattagtttaaaatttccagaatttctagaattttatgtaaatgaacaatatatacttcttttggtctattttttatttttttttactcagcataatcattttgagattcttttatgtcatgtcttttaccaatggttcactcacctttattcctgagtagcattccattgcatggctatatcacagtttgtttttccaatgtataagcacatggttgtcaaaacaaagtaaagcatagggaactaacttaaaggtgcatggaacaacaacaatagcacagaaataaatgctgctatgcctaagaatctaatatgtgataaaaaggagagtataaatcaataaagtaggcaaatttaaaccaagtattttgaagttattaaatggataaatgaggcaaaaaatctaaataggcccctcacttcactcaatatagcaggggtaattaagaagaacaatgacattattaagattatatagtttacatttattaaatcagttgtgacatgatctccttttagaaagattatttagtcgtggtgcgaaggataaactagaaatagtaatcactgaattatggatgccaaagtaaggaggttatggtagcattaggatcatgagttaataaaaacaaggcaatgagaatggagaggaaagggaaactatcagagatttcaaaatttcagaggaagaaatgatagggggaatcatatttttctaactgcaatttaatagaagcaatcccttaacttttttccaggcttgtcttcaggtgatagagacttgtaatttctcttggaaaaacattttactaggtgactaggattcaagctgtaaatcttggttaatcacaaactttatgagtttagattagttgtgtaaccttctggactgtttgctttctctcctgtaaaggtcaactctaagacttcttacaacttcagatttcttggataataatttattatcttgaactgcatctccaattgggcctaagacaacagaccaattcagtgggaaatgaaaataataaatgaattgtatgggctaactaccactcacagggccttagtgaagaaggtgactataatctagattaaaagtctttccacacggtgttttctcttaatgatgaaggaagctgtgcaggcaggaatagggttacagggtactaattcgcttctgctctgctgggttgaatggcactcaagaggttgagtgtttgtaatgaaacacacacaagttctggaggcaagaagactagagttttgttacttttgacaagttacaggtcaatagagactgcctcttaagaagacctagaggaaaatgcaactttttaattaatctcctgtgtttctctggctcatgccattatcatagataagaccaagggatgcctctggtgattcattagaactcttaggctcactgattactctttggtctctaaatgcttctctgtggtaagaagagtagttaacaaaggaagctgggtttccccagaggaccttattaaaactgttgtggttttgaagtgattaacatgtaaatgaattaatgtggtcaatgaaccaagctatgcacacagagcatatctaggaggcagagaatcatacagtctagtcatactcaggaggaaactgtttagcattcagaggtgaattctggaagaaagatgaaaaaggaactcagaattactgctttaatttcagaaacactaaacatgaaatgacagaagattagaagatttttgtagagtttgtacatgttgctttagaatagattcctggagcaaaagtagaaatggcttaccattagagcaagcaggttagctcaagaggctatactaagctacttttgcacacctggtggcaccacatcctatttgcagtctgcaaacatcatcacctcccttaaatgtgacacttgttatatctcagaggcaagttaatcttactcaactgtatagaatagattagagggtggagagagctagctgatttaaactctaggtgaatgttagaaacaaatactgaaattgaaagtcagaaagagaggcaggttttgtgtgaaaagcagttagattttgacttgtgtaataataagatctcttgagtaaataaaacaaaatttctcttaggagttcatcagtttcctttgcagtcctaactcactagggatgtcagagttagggtcattatagcattctttgtgagttacagttagttgtagcctgtttgcatttactgatttttatgagataaagttgctttactaccatttgcctacaaattgtaatggaaattaaaatctatgggtctgtgatgtgaatagttctcctggggttggacagtgcacacctgcatgactataggcaaaaccatgtcagatgagatgtttatttaaaaataaatggctcacctacttccctaaaatttttctttgaaatgactaccaaagatacaggtaggactgattgagaaaaggcagaaattgaaggtctgaaaagagagaaaagtcaagaaagaagaataaaaagatgtagtctgggaagtattaggcaaattaggcttgagcaatattatgaaagttttcagcattgttcccttataattgcaaaatgggaagtattgtcacctctttcattttttggaagagtttgtgaaggattggggctaattctttaaacatttgatgcaattcactagtgaagcttcctgggcctggatttaactttgtggaatactttttgtttacttaattgatcttgttatagatctgttcggattttctatttcttcttgagtcagttctggtagtttacgtctttctaggcatttgtctttctcatctaggttatccaatttgttggcatatgccattgttgttcatagcattcccttataatcatttttatttctgtaaaatttgtaatgtttctattcctgattttagtcatttcagtgttttctctttttttttttcttggtcaatttagcataacaaaaagtttgtcaattttcttgatcttttcaaagaagacatttttggtttaatttgtttttctctattgcttttataatctctatttcatttatttccactctagtctttattatttccttccttcttcttgctttaggtttagtttgttcctttatttctagtttaaggtaaacagatgattaatttaatattttttctttttataatttggtgtttataaatttccctttaagcactgctttagctgcatatcataagttttgttatggattttttgggtgtgtttttgtttcctttaatctcaaattattttcatatttcccttatgatttcttctttgattcattgtttatttaggagtgtgttgtttaattttcacatatttgtgaatttcccaaatttcctttttaacttttagtttaatttcattatggtagaagaaaattatatagttttaatccttttaaatttattattttttccttttggttcttttgttctaatttctatctcttcattgatattctatagttagtgagccataattcttatagtctcttagttccttatttgtgattttttaaagttctttgaacatgtttgaaatagctgatttaaagtctttgcctcataatttcaatatctagcttcctcaaactttccttttctttgtttgacttttctgtagaccatatcttcttgtttctttgcatgttttgtctttttttttcatggaaaacttgttatggacattttattttacttttgccttgaaacattttatttatttatctttaaaattttatcattttttgggagatatttaacattttaaataatatggcaactctggaaatgtcactcaccccctcggggtttgttgctgctgcttgttattgtgtttgctatcagtttgtttactgactttcctgaatgcatttgtaaaacctgtattctttgtcatgtgtggccattaaaatctctgcttgtttagcttaatggtcagctaatgattggatagagatttccttaaatgtctggaatcagtaggtctcttatccttcactgatgggctttgtgcatgtgtttcaccagaccttcaatatttagcctggcagtttgcaactctgccttagccttcacttcttgctctcacagagcttcaaggtcagtcttaggtgagatattaggtacttcttagatctttcctaggtcttcaagtggcctttggcgtgtatacagccttctgtgtgcttctgcatggctttctagagtttcaggaatatgttggagtttttcagagccccctattgacatttcgttattcagcttttcctttaagtgtattggtcagtttcttgtttgttccaccattatcatctcctcaggcagtggcaatgttaaataattggtgcttattgttttccacctcctcccctccaaaaaggttgtttgcaatgagcaagttctgaataagatcaaatacaggcaagtcttgccaatggaggttgcaggaatatgccagacaggtcaaataatgacagtgctctgagaatagtgtttttggggagctccaaaccagctttgccctgtctagtagcttcaaggctgctgtttctcaccattatggcagtgctgttggttttcaaggctattggagagctggggagaagaagacgagaacaggacaaattaaaacaccacaaagttgctgctcactgttcttatctagatacagccagttttcatgagtaaatgcttcttgaattattgcaagtcttttgttaatttccagagttcagaaaaaaaatatttatttatttattcattgtttttgagatagagtctcactctgtcacccaggctggagtgcagtggcacgatctcagctcactgcaaactctatctcctgggttcaggtgattctcatgcctcagcctcctgagtagctgaaattacaggcgtgtgccaccacgcccggctaaattttgtatttttagtagagacagggtttcaccatgttgcgaggctggtcccaaattcctgaccttaagtgatctgcctgcctcagcctcccaaagtgcagggtttataggcatgagccactgtgctcggccagaataagttattttgacaatttttttggccagtgttttcattgcctttgtgaagaggtggtttttgattgttatgctgctattctcactgacttcactcatgctattctgtcatgcctcaatcaatcttcatcacagagcacagtctcttcatcatttcccacaaaatccagttacagcaagtaattatttttcaatagactttattggagtctatttgaataattggcagataaagtcccatttttgttgtatgttactttttgccatcttggagggttttaccattttttcctttacttatctcccaccctatccccagatgcctctccctgtaatattaaacctattctttcttctttgatcctacttggtgttattttcttctctaatcattgtccaaaaccaatgaagttctcttagaactttggaagaattcaaatgaattagaattatattttgttataaatattaaagtcccaggtaagttgcatatagatcatttcaaaatgtcttttcaagctatccaatgacattttggctggctgctgcttgtgaaaccaccaagatctccatcctccttctttctttctttgtctctctccacctgaattaatttttgtcctttcatagatgagacctatttttttttgtaacttggagagaggtgagaaaatttggatcagtaaaaaggctaaggtgaagagatgagaaaatattggaggaggaaggcataccatctgttctccacttgtctcctcatactgattttgagccccctgtagagacagaattttagagatagaagtggattgaaatatgttcaaaaggagctttgtgagatgtacagaaaatacactctcttttccagcactaatggacattctaaaaaattgggcatgtattaggctacaaaggaagcttcaataatggagacattgtagctgcattctctttttggtcagaagcaagacagggataaccactatcagtgctactctttgttattttcctccagtagtatgtttgcagaaatattctttagtgtatacatcagatgatatcgtttggatatttctccccactcaaatgttgaaatttaatccccagtgctggaggtggggcctgatgggatgtgtttggatcatggcagcagatccctcatggcttagtgctgtctttgtgataatgagctcttgtgaggtctggttatttaaaagtgtgtgacactttccaaccccaatttgctccttctttcgccatgttacatgcatgctgcttctttgccttctaccatgactgtaagcttcttgaggcctccccagaagctgatcagatgccaacaccatacttcctgtaaagcctgcagaactgtgagccagtcaaacctcttttctttataagttatccagtctcaggtatttctttatagcaatgaatgaatagctaatacagtagggactatgcctagcactttctaggcagcaatggaagggctttgtatattcagtagtgagtgttcttgttgttggttgagtgaatttgtagtgttagggtgagtagtgtgagatttgattgattagagaattccctgtgctgtgtttaaacattgtttttggctgtatagcattgaattctcactgcctatctctgctggagagtctgtgatctatttaatatatcttaatatctttcttttctacttaaattagcttagtagattttattaagttacatctgaatatttgactgacaaaaagaggatcttgctaaagctaagatagtaaaaatagtatagtagtattgcagagaaacaacaagatgaatataaaactcaggaagttcaataggtacatttgtgaatcaagttcataggtgagtctaatatgataacgatgatgccacaaatctttagggaatggtggattatttagtagattgtgctattaaaactgtcctgctctatggagaaaaataaagtagttgggtcttctacagatgtaaattttagatgaattaaaacctaaatgtaaaaaacaaatctataaagataataaacacagtgtgggaaaatgtatttgtggctttggggtgaagaatgatttctaaatcaaaatccctaaagcccaataaggtgaaaaaaatgataatgttgattccttcaaaattaaggatttccattaaaaaaaaaggacaccatagacaaagctaatagactgggaccatattagaaaaagatacttgtgattttggatacagcaaaaaattaatatatgagaaactcttatgatttactgagaaaaactagaggtctaattttaaagtgagaaatcatgtatatggataacatgggaaagggaaatacaaatggctcaatagactaataatcagggtaatgcaagttgacattccatactcagtagattggtaaaagtagacagttttataatactaagtgttgttgaggttatggaaagactggaatgctcatgcactgctcgtagaagtgtaagtggctgtagctactttcaatcattaccgtcgtgaaattgagtatgtgtatgtactatgattgaacaatccttgctggggacatatcctagagaaattctcacatagttaataggtgaaatgtaaaaaaaaaatgttaattgctgtgtttgcaggagttacaggcagcctataattccatcactaggggattgcctaagtaagtgtggtgcatgctgaaatactgtgcagtagttactttgaaccaaaagtacataaccagtatctaaaaagagttttaagttatctgtagctctgtactaattggcttcagtaagaagctgcttaaagccttaatcagcttacttgtcaaattgtattccttttgtgttcccctctgtgttttggttgtcagaaatttcagagctcaaattaatcatagtagcgatcttagtccttccactaaatatatctgtccacttccctttgatttttctatcctcattttagaggcatttttgaattctgtattttatttggaagctttttgaggtcgtatatataaataaaaggtttctgttggacctaaatgatcatcttatcattattattatttttatttttagatggagtcttgctctgttgtccaggttggagtgaagtggcgcaatctcggctcactgcaacctctgcctcccgggttcaagtgattctcctgcctcagcctcccgagtagctgggatcacaggagactgccaccatgcccaggtaatttatatatttttagtagagacagggtttcaccatgttggccaggctggtctcgaaatcctgacctcaggcaatccacttaccttggccccccaaaatgctgggattacaggcttgacccactgctcccggctcatcttatcattattaaggactctgtcattaagaaaagagaaaagattaggaaagaaatggatttcctctcacctagaagactattaaagaaaggaaaggggatgcataaagcaaccatctgaagatggaaaaagaagtgtgttactccatgaaagtatgtgtttaatagccactcacctgaatgaagaacatcttttagtattcagaaggcttttccaaaaggcagttatttcctctggatagccttcatattcctatggaaattgaataaggatgaaaaatttgaacaaaagcaaaggacatgaaatctcttgaagatatgagaagctgtgaacacttgtcttagagggtgcatggagaaattatttttcatgagttcccatgtagtccgctaggtggcggaggttacataaaaaccctactgtataaacactgaattgctacacacttgtgtttcctcttctttttcaagtaaaatcccaaggaaacctgtagagtataataaaagctggagatagaactttgtagtaagccctatattaataacaataacagtgtcaggttgcaaaatgaggataggtaccataccaaaagagatgatctccaaatgcagtttttgtttcttttgtttacagaaaaattacaactgatttttttttccatatttgttccaaagatcaccttgaatgcaaggaatcaaattttgatcagtatatttacacagtaacttttgtaccttaaaaaattcatttcttatctactgcagctactaatatctcacgctaattattttaaacacattagcaggtcatcatgtcatatgtgacgggacttagcatactttttgtgtgactatatcactttaatttgtgtgatgaagcagtgccccattaattatgtgactccttctaatacccttagagaagaaaggaagctccttgaatactaaatttgcacaaccacagtgaccttataaaggatgcattcccttttaagattaatttctcagaacaaagcacagtgacgtcattactaagcagcctcacaactgtagcaacccttctaaaggttgtagattctggctgatgatgtcactgacacaaaggaaaaaatgcaaaacaggtagtcttaaataagcattctggtgagaccaactgcattttggccatggctttgcagagcactctgggggcggtgtggctagggcttctcctcaactctctctggaagggtgagtagcctccttcactatttggttttgtaaaagtgtatgaaattgttttaaaatttggactcatttttaatacaaaaacaagagaagtcagatctaacattcactgtacctaaggggcaatcaacaagccaaatagtactattaaagtgacagccctttttgttttctgtagttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgctgtggaggacacagaggcagggaacccatgaagagctgaacagaaacagagatcacagcctttgcaggaggcaaaacagagatgagcaataactttttcctccttaattcagtattacccaagctttttcatttggtactgctattaggaaaaaaaattgagtccagacatactatatattaacaaatgtctataaaaatatgcttttaatttttttttgagacacagtcttgctctgtcatacaagttggagtgcggtggcatgagcatagctcattgtaacctcaaactccagggctcaagggtagctgggactcagccttctgactaggtgagactataggcatgtaccaccatgcctagtgaattttcctcctttttgtagacacgagttctctctgtgtcatccagactggtctcaaactcctggcttcaagtgattctcctgctttggcctccaaaagtgttgggattacaggtgtgagccaatgcacctggaccagaaaatatgtttttaaagggtgattatttcaaatagtcttcctgatatctgaaacacttttgactcattttcttgagatctgattagattatttttgtttttccctcataaaatggctgatgatgaacttgtgatagtagtaagaggcatgtccactcttccattttcttctcttttttaaaaattcagacaggctggagtgcagtggcatgatcatagctcactgcggccttgaacttctggcctccagtgatcctcctgccttgacctcccaaagcactgggattataggtgtgagccaccaaggccagtcaactctttcattttcttattgctgtctgtgcttaccttttaaatactatctgctaacttcagtctttttgcagcaatattttcaaaacatgtcaatttgtaaaggatggtttagttaacattgggtaatgtaataagaagtgagaaaggaaggaataaatgagtggctgatacctacagccctgcatttgaaatctcaatccatgcctcagtatactttgcttataatctagcatacagtcctgttgagggtgccagtcaatgagtatatgaaatattagtcaaactgaatctccttcataatatttaaactaaaaacaaatgcaaatggaagtatttgtactcattgcaatgcattcttcccacactcctgttaattagcttggtcctcccaccccagatgtgtccctcccactttagagaccaatgccttagggtagcccagtggttcttaatatattttatcctcctagatcggaagttttgtgaaaattggatttgttttcttggggggccatattctagataaactcaatcagagtttgcaggggtgggacccagaagtctatattttccataaagctctgctggtgattgttttgctcagccagggttgatctgtgaatttcagattttggaccccaggtgtattactccattctcacgctgcaataaagaaatacccaagactgggtaatttataaagaaaagaggtttaattgacttacagttctgcatggctgggaaggtctcaggatacttacaatcatgatggaaggcaaaggggaagaaaggcaccttcttcacagggcagcaggaaggagaagtgccagcaggggaagtgccagacacgtataaaaccatcagatctcgcaagaactcattcactatcatgagaacagcatgggggatgccatctccatgattcaattacctcccaccgggtccctcccacaacatgtggggattattacaattcaaggtgagatgtggatggggacacacagccaaaccatattaccaggtcttgaggctttaaccactattctctacttccttttaggtagaattttagtaacagagaagggcttcaggaagtgaactgtacagtgctattgcttgcttacacagtagactttcagcaaatgctgacatttggaataaaaagtgaagggcaagatgggcacgatgggttatacctgtaatcccaacatttgggaggcggaggtgagaggatcccttgagcccaggagttcgagaccagcctagtcaacatagtgagaccctgtctttacaaaaaataggaaaaattagcctggtgtgttggcatgtgcctgtagtctcagctacttgggaggctaaggtgggaggattgattgagccagggaggttaaggctgcagtgagccatgagggcaccattgcactccagcctgggtaacagcaaaaccctgtctcaattaaaaataaaagtggccaggtgtggtggatcatgcctataatcccagcactttgagaggctaaggcaggtggatcgcttgagctcatgagtttgacaccagcctggtcggtactcaaaataccaaaaattacctaggagtggtgtgcacctgcagtcccagctacttgggaggctgaggcaggaggatggcttgagcccgggtggcagaggttgtagtgagccaagatggcaccactgcactccagccagggcatcagagtgagaccctgttaaaaaaaaaaaaagaaaaaaagtgaagagcagattgctgatgacagaagaaaaaaggtattttagtaatatcaattgtcatgaaactttgccaaaatgtcataagattgattcttaaatgcaaatttttaataacacccaaatatttccattggatataagtgtaaattggtatgtttgtgcttgtattacttctttaggcatattatattttgggttgttgcttgcttaaaagtgtgttaatcttattttttaaattttatttatttattttttctaagatggagtctcgctcttgtcacccaggctggagggcagtggcgcaatctgggctcactgcaacctccgcctcccggcttcaagcgattctcctgcatcagcctcccaagtagctgggattacaggcacatgccaccatgcccagctaatttgtatttttagtagagacagggtttaaccacgttggccaggctggtctcgaattcctgatctcaagtgatctgcccgcctcagcctcccacagtgttgggattacaggcgtgagccaccacgcctggcctaatcttactttttaatcaaatgaaattcttgagaagaggaagcatatgtgatccttctttcaggttgtcctgcatagttctgtgtgcactgtagtggctcaataaatcatgaacacaggtgtgacctcattgctttggcaagagagaccagagacagaaaattccctttggttacattaggaagttctttccagttcacagaggagtctgtacatgtggtatactgaaaaccctaccttttaccctggtgttttgattctataattcaaactgtcaacaactagtcttctaccagattttttccagcttacatgaagaacactaaaggcattattatccaaaggggaaaatggaaaaagagagtgaaataagaggaaaatgcagttgatgcatttttcttacaacgaagagagcagccatgaagtcccactcttaaagttataacattatgaagctcccagttcagtggtgacaaggacagaaacatccacaggagaataaattttttttttttactcccaatcctgggagttcatatatatgaatcgaaaggtaactgtgtctgtcactggctccatgagaaatctgaaagacttgccatgccttgctactgtatcctacgtcctctgacttcactgctagttttcttttcttttttttttttttgacggggccatgaaaaccacctacggtaatcttctgtaccttctgaaaatcatggcgccacagagaatggggggtatttggaaggctgtgttgctttcattttcttcctaggattagtgttatgggttgaattatgttccctaccccttgccccgcaaaaggatttttttttgagtaggtgacacgggtaagtcctagccgtcagcacctcagaatgcaaacttatttggaaatagaatctttatagtggtgataaaattaaagtgaagtcaaaaggatgaaccttaagccaataatgactggcgtccttataaaaaagggagatctgaacacagagacagacatgcacagagggcagacaatgtgaagaggcacagggagaagatataaaaaatgtagtatttttcagaggtttgagatagcatggatatagctgggaccagaacacagcaataaactgtgtggggagattgaaagtcagatgtgaattaaaatattttgcagatgcttgtgtagatagataatgatctcaaggtccagtttacatttattttccctgtgataccttggaactacataaattgcctagaaattaggcgtaatctcaggaaaaggtaggaaaactctgatttgactgagatttggtttctgatacctggtagactatagctttaaatagaaattaaatatagttatgaaaaaagtttttttccctccttcagcatctacttttgtgtattgaaattatacttacagatgatttaaaactttgctttcttggaaatgtatgaaatgatgatgattttggtaaaagggataatactgtcttaaaccacataaggggaagacactgtcaataggactctcatggatgaatagtattccctttggactcatttttgaaaacctgaacaataaaatagaagatttaaaagctacacataaactctcacaaattcatctgtgacatcttttgcatgatctttgttctagtatttaactgaatttttccataatcttctatagccattttctgtcctgctgttctacattcttttaccagattatctcaaaatgtatccttgattttgttattccataaataaaatccttcaggctttttaattttatatataagaaagaaacaaaaagaaaaacagcaaatctaaatagaagtaccctctgcttagtaaagctgtcatattatgaacccaatgaaactttgctgctttactttctgctgctacatcccctatccccttgggtcaccaaataagtttattctctagcctttaagacctgttggcattatctcctgtatgagttgtatcagattattttctctgcctgaaatgccctctttctccctttattcagattgtagcccaacctctataacttcttcagctgaggactctctcccttgtttgtgctgctatagtataatgatccccaaagtgtttgactgtgtgctattatcagtaaagtatgttactcctccaacatatgcatatttatatgctcatagattatgatcgtgtgtgcaacaaacaaaaatagaaattaggaaagtttgagataaatttaatactaaatgttgtgattttcttctcgcacgcagggggatcatcttgtgtagcacatccgtgtcccttctacaagatgaactaactagactaacttggtctttaactagttggctaaatttcttaaactttgtgaaactctttcttctctcatttgcaagaaatatctgtaatgatttttctattgatataattcttgcacattttacttcagatagttaactgttcttcccctaagtgttcatctaccaaaatggatggtaagtttctggagggcaaggattatgtcttgttcctctgtttatttctcaatgcaaatggtatcttacatttaacaggtactgaaaagtgatttgtgaggatcaatggattcacagggttttctcctggaattgtcagaatgccaaggcagttcttaagtagattcctggatgaggaaccctctctgcaaaggacaaccatttgtgatgaatgaacggaaacagagctcttagatcattgcgtataagatggcctctcattacatggatttctgctagctctgtgtacttatttaaagtttcaatcatctgacagttatttattgggtgcccataatttgccaatcacatgttttttttctttatatctgtcccataaaacaaaacaaaacaaaacaaaacaaaacaaaacacccatcctcagagcttctctacaatagacacacaccaaactaaaaataaaaatgcatgaatctcaggaagagaagttctaaaaaacaatctagaccatctgcccatgggatgcttgattttctcaacagcatcacatcaagggaattgccaatattttcacaacagcttcttgcaggagggttcttgctgctcccatactgtccattcaaactccaggcggctgtgagttgaaaatctattattctttatgttgaggaaacatctgtgttcctgtggcttctacacctttgggaatctaaaagagttcacatctctcctttacacattttgaaccagatacaacatttccacagagcagtttttttccatattaaatatttgtaagtttcctaaccattatatatatatatatatacacacacatacatatgcgctacaattttgatttccctctttgttgtacattttaaaccgtttccagttggcttgtatttcttttaatatagaattcttagaacttaataaaacacttcagatgtggcttgacctattttaaactacaaggaaagaaggaggaaactggatgaaggtgaggcaaggtaaatatattaaacccagagacactacacaaatcttttcattccactgagacatggatggccactgattcttgatctcctttgtttggaggtaggagggcagaagttcaaattacagatttgcccccacctttcttttgagagttccctaacttatgtgaagtatgatttgcttagttggactgtatattttgtcagtttcatggaaaaagcactgatttctttgttctaacaactttattttgtgctgatttttctttgatacttctaaaataaatgtaatgtacatttcagagtctaatatttgcaaagggatttgtcattagtttacatgagccatttcttgtctcttgtgaaatcaatgatatttacagagttctgatttttttttttttttttttttaaagaaacaaggtcttgttatgttgctcaggcttgccttgaactcctggtctcaagggatcccgcccccacccccgccctgtctcagcctcccaagtggctgtgactatagtcatgtgccaccgtgacaagctaagagttctgatgtttgcaagtagtttcttgagaaaggcattggcagccttggtgaggcatctggagtctcagactgatactccttgacactgctctgtgctactctaattgcccttgtgttgtgatgtgcatgtttcagtggtagttaaattaaggagtaaaggaaactaccctgaggggagcacagacatctacctgcagcattttgggcacattccccattggcccacccatctcatatttgactgacctctaaatggatagcactacacccagtttactatggtttggagaaacagttcatgtcaactttctgtgaatgtcatggttctttcaatagaaatcggagagttggacagaatagctaaaaggtggtccagactgggtgcatatggcaaattgataagaaagagtcaagttttcatcaaactttctgtacataaacctgtaccagcatagcagtgagcaagaggtgcaggagaaggtggatgacctttgagtgctggtgatttagaattaattatccaggagttgttttggttcagtggcacatacatgtgggatcggcatttggtataatgcactcaatggacaatatgacctctaaagttctatttaacttattcaagcttgattctgtaattttattatgataaggaagctgctttccaatattatattgtctttaatagaaagcaaattaccaaaattgatattccccctatatgatttaaaggaatatgcctttgaagtcggtaaaatatgggttaaaaatctttgttctttttcttaaggatgatgagcaaattattcaattttcctcaactgtggtcccctcatctctaaaatggggcatcttaggaagagtaaatgtgacaaagaatgtaaagggtttaatgttatgctcacggcgacatttgatgaataatttcttaattaatctcagaaatcaaagcagataagctgaatagctactgaggctatgttgttcaattttgaaatttcagtctaggcccatggaattctttgggtgctgctggttactttgtgtgcagtgcattatgtggaggtccctgaatccttctctatctgctgagcagttaaaaggcagttctttaactggaagcaaacacgaagactaaactgtcctagttttgaggaagaataagaaggaggaggaggaggaggagaaggagaaaatgaagatgaagaagacgagaagaagaagaagattaagaagaagatgattaaggattctgcaacagttctgtcattgcaaatgactacccatttctaaccacgacataaattcagaggaaaactttcctctttctatagctgaacatgcttaattaataaatatggttagttccttccataagtatcctttagggggagaccactaaacaatcaaccatttctagcacaaaattaaaaatatcagtctcctaaatatttagttcacttgaggctcttggcattaattattaaatggatgaaggcaaacaatatctcagccacttgcacgatctaggcataatcttgtgtgctgtatctgtagaggtcagaggaagtagggattggaaaaataatcaaggcactgaagtctacactagactactgttttagttaaacttattttatttgcttttttatgttgatcatatcatatgttgatatatgcccatatatgcgtttatagggcagcaataaactccagtgtcaggaggctggacagtctctgttttcctcttcaggtctattctatcctgctctgtactaaagtctatattagactattgttttaaacttattttatttgtctttttatgtttgtcaaaatgcagtatagctatgcccgtatatgcatttgtagggcagcaataaactccagcatcagagggctggacatttctccattttcctcttcaggtctattatatcctgctctgtaccccaggaggctgacttctatacgttatgtggactggtctcccatgtccattggcatctggttgggtttaccccagtgggaggtattagcaggagagagtggtcaagatatttgcattttaggatcctttctttcctctactgaagtttacagctcctgttgggtctacccagaatatggtcaagaagaggtatttagactgtaaagggtcatgtcgcctttggcctgtgattagttacaggtgtcctgagattagggtaatttcatcttctcccgtccctttgggcctaggagtggtgaaatcttctggctgttattagccccaggtgcttcaccttcccttgtagttttccctaaattttgcacatacacttaaaaatattctttttgttaagctttttttcaatgattttctcgaggcgattgccaggaccctcaaaaagacaacactaacactcattttaggcttgaggcagagagagaagaaagagaagaaattcactatatgtttccatttatgacaagtctctctggaacttgaagattattgtttaaagacagtttaccaattccaaagaaaaacattattatatggctaagttttcaatgattaaatatgagatctttagcaaagcttttagaaagaattatgttccactttttttctgattcaaagcaaagagatttttcatcctttcctcagaatatatagtgaacattatttggacactattcaaaagaaacagaaggcaaatcagaggaacaacttctttatattgatacatgctttttacattaaaattaaaatctatcaaagaatcactcagttgctattgttgcctttttttagtataaaactttagcatgccatccctttccaatgaaccccttttccccatcataatacatcaagtttcgttaaccatacattttttgctgaatacgtacttcatttgaagtctgttttaagtaggctctgcatgtggaaagtacctgttttgcaaccccttctcagagtttcatttttttgttttatatgtactgtttaatatgacaaatgctccaaaaatatttataacacctattcgtacttttctcactctaaaaatgtttaaagagaagattcaagtttctttttgccctaaagatcattatgggatgggctcctaataggcccaacgtggagaaaattctgagttatttttggtcaaagaggtttacacagaagccagctctgaattacttctaacgagaagagcaaggctcctgttttcgcctgtcatttatcttctcttgccttactcttttctcctattttgctttttcttatctctcactttaaatttttctctccctcttgatgcaaagctatattttcctttctttttctgtgcattttcccatcctatttcccttctttctgtctctacattatcttaagagagcacaaatcatttacagcttgatccactcagcctgaatcttttccactttgattcacaaacttctatttcttctcctttgaacccctaatttgctccctatgtccctcatggagcgtgtaaccatccaaaggttggcccagggataaggccaggaagcaccagctgcttgacagtaaagtcgctggtcctacgtgtgggctctagggggcgatgcagtgtaaggtctgtcctgggcataggcggagcggcagtcttgctcctcacagagctttgaggagctggatcaaaattgtgctccacagagagaagataccggtgtcgggaagcaccagtgccctgaggaagggccatttccaaaagccctgtgctgacacagggttgctggttcctcttcaagagcccactctctggggtggggccatatctccagcagaggtgggctggaaaggacccccccaatcccgcccgccgtgagcttagctggagccatggcctctgcacccatctcgatgcttgcgatgctcttcacattgagtgagtaatatccccttcccattttccactcgcatgatccacttacatgctctccagcagcttcactgatgcagcatgattaatttacaggtgggctgagagctcagtcagtggctcagccggaagatcaggtcaacgttgctgaagggaatcctctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagacacacactgataggggctgcagggggagcagaacacaaactcttgagtctggtaaagcccattttcttgaagtctttgttccttcacatgagaacggtgtgcttccaggatatgtcacttattatgttaaactacaatttaaaaccatagaatttgctcattcagcaagtgtttattgagtcctgatgtgccaggtactgggcaaagcaccggtcataaaaaggtgaaagaagtgtaaaacaaatagaaaaaaacataggggaaaattaccatgacattggtctgggcaagaagttccttccttccttccttccttccttccttccttccttccttccttccttcctccctccttccctccctgcctctctctctttctttctttctgaaaaggggtttattttcaacagacatttctttttataccgaggtgaaatgtcatcatcataataattttgcaatgttacataccctgttgagaccattaaaaaattaggttcatggtatacacgtccaagtttgttacaaaagcatattgtgtgatgctgtggtttgggcatctattgatcctgccacccgaagagtgaacatagtacccaggagaaagcttttcatctcttgtgagcaaggaatttttggatatgaccccaaaagcacaggcaacaaaagcaaaaatagacaaatggggctatattaaactaaaaagcttctgcacagcaaaagaaacaataaatagagtgaagggaaagcctatggaatgggaggaaatatttgcaaactctacatctgataaggggttaatattcaaaatgtttaagaagctcacataccaaaaacatccaaataacctgattaaaaaataggccaaggaactgaatagtcgtttctcaaatgaaggcataaaaatggccaagaggtatataaaaaatgctcaacatcattaattatcaggaacgtgcaattaagaccaccattagatatcacctcacaacctattaggttggctattatcaaaaagacaaaagataacaaccattgttgagaaggtgaagagaagggaactcttccacactgctggcaagaacgtaaattccataatgtgcaaccattatggaaaacagtagggaggtttctcaaaacaccaaaaatagaactactgtatgatccagcagtctcactattgggcatatatccaaagaaaatgaaatcagtatgttaaagagatatctgcactctcatgtttattgcagcactattcacaataaccaagatatggaatcaatctaagtatctatacttagatgaatggataaagaaaacatggcatataaacacaataaaatactattcagtcttataaaaggaagaaatcctgccatttgtgacaacacaattgagcctggaggacattatgtcaagtgaaataagccaggcacagaaagacaaataccacataatctcacttatttgtgtaataaaaaggttgaatttatcgaagcagaatagaattgtggttaccagaggcttgtgaggggaatggaaagggattggagagatgttggttaaaggacacaaaattttaattagataggaagaataagttcaagatatctactgcaatggtgactatagctaataataatgtatttgcaacagaattttttttttttttttgagacagagtctcactctgttgcccaggctggagtgcagtggagtgatctcggctcactgcaacctccacatcccaggttcaagctattctcctgcctcagcctcccaagtagctgagattacaggagcccgtcactaaccctggctatttttttgtatttttagtaaagacggggttttaccatgttggccaggctggtctcgaactcctaaccttgtgattcgcctgcctcagcctcccaaagtgctgggattacaggcgtgagccaccgcgcccagctgcaacagaaatttctaaaaattgctgaaagtagattttaagtgttcttaccacaaaaaggatatgtatgtgaggtaatgcagacgttaattagcttgatttagccattccacaatgtacacatatttcaaaacattatgttgtataccatacatatatacaattttatttgtcagtttaaaaaagaattgaaagaagctatctttgatctctatgtgccaggtgtgtttccaaacattaatgaacgcatttaattctcacaagtattatcatcagcttcactttacagatgaagaagcaaagtcacagagaatttaagtatcttgctcaagtcacaaagttaataactggtaaattgcaacccaggcagtgtgtctgtagggcacatggtccaactactccactcctctgccagtctataggcttcttggggcaagagactgattttggtgatggtgtagccctaactccagaaagggtcgctgtcggaaaagtgttggttatatgaatgaacaatacactgacactctaaacagtttggtgtgtgccaagatagagaattcaaaaaatgctctatgagatgaggatataggaatagcttagctgtgaaagaagacagaagcagtctgtaatgggaggagagtttgaatcaaggaagggtataaacgtgtagttcttataaggatagttgcttacggttcctatgttcacatcttccttatgctcttgagaggaactggacttaatgcacttttctctctttatcttttcccaaatttgagtgtcgtgggaagggctctgtttgactcagtgtgagttaggtggcttttccttggactaatcagtggtggccatgggtacaggctgcttggattagcccagcttggcttccacctttggtggctgggggtgggagtgaggattctgcaagttagcagctctattttgaactgcctggttaaaaggagtatgtccccaaataagttaatttttacacagggatctacatctgtttattttttcccccaaatggatagccagtagttcttacaccacctcctgaaaaattcacttttgccccatagatttgaaataccatatttatagtacattaaattcctagatatactcagatctacttttgaactcttgatttttatagttttgtgctagaatgtgctgctttagggagattcaccctgcagcctttggtttgtaccttgtgatttaccagccttcttttcctatccttcaatccatcacataccttgagaagccttatacacaaggatgtggacaccttagcccacatgtctacagtccaggcaaacagtgatcttttggccacccattgggcctagagttgtgtacacaggtgggatatctgcttctgggaagataatccttgagataggcccatgcagatcttaaaagtgtgtttggggatgtttgtgcagggaattctgaaatcctagtacccagaatatggtcaagaagaggtatttagactctaaagggctatgtctcctttgtcctgtgattttctcacagggaaagggataagaatagctgaataatagctggggtggaggcacagaactctgagcagggacgtcacttgctcaggtctaagggtggcagtgttctgtaccattactgccagaatacatttgtattcatgaaaccatggtatctgttttagatttaagtatacagttgccataactctaggtaagctctcagccaccatcactgttttcactccaaaggaagttcatgtccacagggatatttttatcacattacaccattgacctggctgtgtggcctgtttctgcctttgatacttataaatacaatttatgcaagtcctgcaaaggaaagaagtctttctatacaattatgatgtatttattcatttagctattcacttattcactcaatgattatttgtggagttttgactatgtgcttggcattgttatcatccctgcagatgcagtggtgaacaaatctttccctccagtcattccccaggctgcacacgtgttcatatcacttccctacccaaacagaactacttcttagtcaaagagatacaactctcaagatgatttccttctcaggaaaattctccaaggttaagctaagccttagatattaatcttttgtcatgtggtagtgattggtggtggtggtgatgggaggggagttatgtagggaaatgagaatctatattttcccccttttttaaggtggctcagagggaacaactatgtctttttagaagttctgttttgacttaaagaaaagttagtctagcattcctttttcctgtttgttgggaaatactccttataaacagataaacttcaggaaaaatgagaaattctggaaaacttatcttcataaggtttatttttctccccccttttatatcacttcaagaactttgtggaaagagaactgaattaagaattagggagcataggttgtttctgattcttcctctaagtaactatgtgacattggacatgccatttctactctatgtgcctcatctcttaattaatgaaattgagataactggaaggattgttgtgaggattgctttatgtgtgacatatgtcttggaccccaaataagagtgggtatttaggtgggcagagcaatcagatacctaagacaccaacactgtggagcccttataactgccctgaactgctgacatttgaactgtatcatgataaattactttattttggcctttgttacatcagttggccctgtattctaatttaatcttcgatacctgaaaactgctttcagaaaaggagctaatattatctgtgtacattgtagttaagttgcgtttaagcaccaacttaaaaaagctatttgtggaatcacagcttttgtccttgaaatacacttttaagcattttagagaaagtaaaggtagggaaacacgttttggggaagaaaagttgtcctggttttgctgagaacactatgtagacagtcatcttctcatccatgtgagaatctgtctctgcctggatacaagggagacacctctccctgcagtcttcccatgctacattcagtcctccctcctctcatctttccctgattgtgtagtgagtttcactgggttctctgaaagaatctttgaattccattctaattctcaaaaattgtgcttctgtgatatgcaagagttggtggggttccaccatgaattccaggagaggccataggtaagctgtggtcacttgctgtcatcagcactgcagggatcccacacatatcctgcaaaatgcctccttctgcagtataagtaatgaacaagtattaagtaaagtgatatttcatttaactattaaattagcaattgtaaactgtataaacaatattgacaaagagtaaatgggtactgaagtgtactattgatggcataaactcatatgatgcttttgggaggcaatctggcaatcttcactgtgtctcttttctcactttttacttgctcttttacccactgaagtgtggttttaacttccaccattggcccaaactattcttgccagggttaacaacagtttcttgggttacatccaatgaatgattgattattccctctttgaaacctggtcctctttcggtttctggtataccactttccctttaaaaaaaaaatttgagagctgattttcaatagatcacagtgagggagctgctctgctatgtgtgaaaccccagcctacctctttctttttgatgttcttatatctttggctgaacctgcactgtcttttttcatgggcttttcttctgctcactcttttatcgggaacctgccctgatattcacgtaggttcctttctatttttcccaagcgtcagccggcttgagaaataaagggacagaatacaaaagagagaaattttaaaactgggtgtctgggggagacatcacgtgtcagtaggttccgtgatgccccacaagccacagaaaccaggaagtttttattagggagtttcaaaaggggagggagtgtgcgaataggtgtgggtcacagacatcaagtactttacaaggtaatagaatatcacaaggcaagtggaggcagggtgagatcacaggaccacaggaccgaggtgaaattaaaattgctgatgaagtttcgggcaccattgtcattgataacatcttatcaggagacagggttttgagatcaaccggtctgaccaaaatttattaggcgggaatttcctcttcctaataagcctgggagcgctatgggagactggagtctatttcacctctgcagtctcgaccataaaagacaggtgcacttagggggctgtttataagcctatacctccaggcgcgtattctctttctcagggatgttccatgctgagaaaaagaattcagtgatatttctcccatttgcttttgaaagaagagaaatatggctcagttccccccggctcaccgcggtcagtttaaggttatctctcttattccctgaacaattgctgttatcctgttcttttttcaaggtgcccacatttcatattgctcaaacacacatgctgtacaatttgtgcagttaatgcaatacttacagggtcctgaggtgacatacatcctcctcagctgacaggattaagagattaaagtaaagacaggcataggaaagcacaggggtattgattggggaagtgataagcgtccatgaaatctttacaatttatgtttagagattgcagtaaagacaggcataagaaattatacaagtattaatttggggaatgagtaaatgtccatgaaatcttcacaatccacattcttctgccatggcttcagccagtccctccgtttggggtccctgacttcccgcaacactctttaaagttggtgttcttttttttttttttttttttttgagacagtctcgctcttgtcgcccaggctggagtgcagtggtgcgatctcggctcactgcaacctctgcctcccaggttcaagcgattttccttcctcagcctcctgagtagctgggattacgggtgcctgccaccaccacacccagctaatttttgtacttttagtagagatggggtttcgccatgttggccaggctggtctcgaactcctggcctcaggggtccgccagttggtgttctttaggattcttcccttgacctatttattttctcagtcaaaaattctttctgggtaatattatccatgctcatgcttccactattatttgctgattattttcagctcatatatctcttctgagcttcagtttaatatatcaaactgggtttttgacctgtgtgaattttccagaagcaccttaaatcaaatggtgcaaagcttagctctttatctttcttcctttctcccccacttcaccatatgaaacaaaacaaaacaagataaatttgctccttcttttgtgtttttcatatcaaacaacaggaccatcatctacccaagtgccatccactctcttgctccaagcctgtccagatgctgtgccttctgcctctttctattcagctcagtcttcatcatgctcattcttcctcttctcttaggttttagtttaggtgagtgtcactccttctgggaagtcttcctgcagtcctacaaccaaaaccatttcacttccttgtgttgctatagtactctatgctttccctactatggctgttatcatgaggactatcattgcttttaaaatcctcttccttctcactagaccactgggtctttcttgtcattgaatggccagtgtctacctcagtgcctgactgtaaaaggggctccacaaatatttgtttattgaataaatggatacttcccaagactcttaaaatgttcttacacgaatccaggaaatcctctttgcagaagctagtctaaataaataattggaagtttagacaaagatttatgtacaaaggtttttatgatagtattctttctaaaatccaaatgtctaatactaaagaaattggtaaataagttatagcacatttgtaccatggactatgttgaggctattaaaattggatttttatgtatacttgttgacaaaaaaaaagtttggaaaagaatattaagttgaaaaaacctccagcatgtgcaaatgtgtgtgtgttcatgtgcacacaattcaattgtgctaacaatagtcatgcaaaaacaaaggattaaaaagcggtatgcctcaatattatcaatgatttttttctgggatatggtattacacgtgattttaaaacactttcctatattttccaaattctgtatttagaattcattattcttctaaccagaaaaaaaatcccacttaaaaagaatttaaaatatccctcttgtagttggctattgctatagggcgtggttttcttccataaccttaggaactttctaaaatttgctttaacaatggtctaaattttttattacaatatacataaaaaacaacattaatgtatgtgatatgctcctatgtgttcacccaaacacttttgaacaccaaaaaatgttttgcaaaggagtatatatatattagttaaggttctccagagaagcagaactaataggatgtctatctatctatctatcatctatctatctatctatctatctatctatctatctatctatctatacataaatatttattggaatatgtatatttattggaatatacgtgtaattattggttatatataaatcttggtccaagtctaaaggctcaagaatcagaagcactgatgttagagggcagggaagatggatgtcccagctcaaggagagagagaaaagttgtccttcctctgcctttttgttctattcaggccctcagtgaatcggatgatgcccacctgcattgattagggtagtctttactcagtctaccagttgaaacgtgaatcttttctgaaaacaccctcacagacacaccccacaataacattttaccagccacctgggtatcctttagcctagccaggttgacacataaagtcaaccatcacaacctacttaacatataatatataatataattattagcaccatatattagtttgctaaggccgtggtaacaagaggccacaaactgggtggcttaagcaacagaaatgtattgtttcacagttctggaggacaggagttcaaaatcaaggtgttggcatggttgtttccttctgagggctgtgatggaaggacctgttctacgcctctgttcttggcttgtagatggccatcttctccctgtacctcttcaaatttttcttctgtttttgtccatttcggtgtccatattccccctttttgtaaggacaccagtcatcgttcaccagtttggattcgagcccacccaaataccacattttaacttgatttcctgtaaaaactgtttccaaataaggtcaccttctgaagtactagggatttgaactccaatatgcatatatattttttgggtgggaggaaaacacaattcaacccacaacacaccactaccatcagtaattactttcattccataggctgagggatagaaaaacttccagtgtttctacctccagttgcctggtatccagtaatattctccaaagtgaggtaacaggtggcaacacggaaacttcaagttccgttttttggcctgaaaaaggaagaccattttggcttggtgatatttcctgcattaaacatagtttgtatttctttttttttttttgagacaaagtctggctctgttaaccagcctggagtgcagtggcgccatctcagctcactgcaacctccgcctctcgggttcaagcggttctcctgcctcagcctcccgagtagctgggactacaggcgcgtgccaccaccacgaccagctaattttgtatttttagtagagacggggtttcaccgtgttagccaggatggtctcgatctcctgatctcgtgatctgcccgcctcggcctcccaaagtgccgggattacaggcgtgagccacagcgcccggcccatagtttgtatttttatagaacactctcgtttagaaataacttacttatgttcatttaatccttataatctctgttgccgagatgaagaaattgtgcctctcaaatggtgatttgaacaaaatctcacagctatcaaatccaaaggattgtttcaattcagtgtgtctaacttatcactcagtgttttcttccataactgaaaatagacttcatagtccaaaccaagctctctgctattgcgtttacaaagaaatgtgacgttccataaattgtgccgatctgagacctactgacttgtgtgaaacattttttctgagtatagttaccacaagaggtcgctgttgcaacgagttgcgtttaaagggtaacccatttattttcatttctgtacaaggtgttctagtatcttcaggtccctcataaaaacatctttgctccttcacttgttactgaggaaagcctggttatttatttcatgacctgtgatagctcctctgtcaaaatgttactagaagccatcaacactcactgatttttttttgcatgggaaaatggaaaaattgctgattcagaatgctttcggcaattctagacctagaagaggcacctcccaaatattttccagtgatttttttcattcctatattataagagaaaagaactcaaacaacataccactatcttttccatattaatgtgagtatgtaacaggttttgtttctagcatttggctgattcaatgagtactactgtgtcttttggattcaatgaatactactgtgtctttcggctcttttcctgaatggctttatttttcttttcagtttttgtgcttctgttataggatttatactaattatttcctgaaggaagtgtgtacagtaactacaaaaaattagatatataatcctacacgactgccttctactagccatggtactctgcgctctgaatcagatgagaagaaagggaaaggaactataatttactgttgactacgtgccacagattgaaaccctgaaatacatattattgttcccattttacagatgaagaaaccaagactcagaggagtgagctgcctgaggtcacaaggtggcagagttgagatttagatttagatctgtctgacacagcctgtgccttttcttcttgttcaccttacctcctccttggttaagtgagtgattccagaccaaatgtcctatcctagctggtcagcagggactaatgagaggtttgttcctctgtttaatatctgttacacagggtctgagaagaaggtattagttgtggacttagtgggattataaatgatcccagggaatcaggagatggaatgtccagtccagactgcctcatttgctctttcttggaataggattaggaatccctgtttcttcttggctaaataggggtcagtggagcactgcagggcataaagtaacaagtcaggcaggttacacttagaccatgactgtcaatgagtccatgagtgtcagaccgactacagtacatgaccaccctctcgggctgtggaaagtaatgtaatggggaataggagcccaatgtaatctaccttctcatagctttgcctcatttggaccaaatctttaagggattagacctctgcaaagatctaaaatgaaattcaggctgctgtgcttcagtaccagcagttttcactccctactcttcttggggctttagctgaactttgaggggagccctgctctgaggagctgctgccctgctattggctgctgtactggggcagcctgagtgacagctgctggtgtgggccctggcagttgctgctgggctcattgcagctcagacacagcaaaagagcctagaacctgggtcctagtttgcacctagaatatgaggcaagtggcgagagtgatcgtgttcctgaccctgagtgagttattttgggatgaagaggaatgggatctgggcctgatgatgctggaaaggaatctggaactttgcctgctagcagttgctctttatccaagatgtagagggatagcttcagggttccatttttctccaggcagctcctgagcatttatgtgagatgtgtctcagggcagcaaagattttcggggtttctaatccctagggtctatccatgggagggagatagtaaacctgacacttctgtgtatgcctgggataaatatttttgtactgaaacataaatgagaagtaaattgtatgtacatgtatatggcagggaagtagagcgtggggatggatttgactgtgagagggaaccgtggggctactgagtgggaccgtctaacttaccttgctttcaggataggggctaggattgtgttttactcccataggtactttgagccttgctaagaccacccagcccatctccatggactcatatgaaggacaagaagtgaacataacctgtagccacaacaacattgctacaaatgattatatcacgtggtaccaacagtttcccagccaaggaccacgatttattattcaaggatacaagacaaaagttacaaacgaagtggcctccctgtttatccctgccgacagaaagtccagcactctgagcctgccccgggtttccctgagcgacactgctgtgtactactgcctcgtgggtgacacacagtgagacagatgggcctgcacctgtgccgttttcctctgtggggtgggagtcacagcctagaaagaagtccaaaagtgctttctaaaatttttattttcaaaaggtattagcaaatttatgtattcttctactatttgcaaaatcaatcttatttattttttaaataggtatttcacttatgtgatctaaaattaaaaaagtataaaagggcatacagcatgatgtcttccttccaccatggtccctgagtactcaattatcaaagtgaggtatctgtggtatttatactattgttgctaagttcactggtactcctcagtttgtgtgtatagatagacacacactacatatactttatatgcataccacgcacagtcaacatgggcaatatgcttcttagcttttgaaacatttagcctaagtatcaggttattatttatagctgcacacattttgaacatttctgtggccatttccaagtatctacatgctggtttccatgcgtcccctgagattagatctctcactctctctgttgcctgtctttctcttttcttttgtcccacttccctattgtggatggtatgtaatggaaaatggaggtgatggtagaggaggagatgggagagaatttgtttctgatttgcattgtagactatttttgaaacatttaaatcagaaatggattctggatcattattagtttttaaagttgggttctttgaggctccaaagagagaagaataacagaaaatttgctgaaaatcctgcttgggctcctgaggcttcattaggatcatggggtatgtttttgtttgtttgttttttgtgggatgttgtctctgattttgatcacaaggaaagcaatatttgataatttttttattgagaatgagaggatcaggctatgtggcaggaggaggtttccatctagttcatctgagggtttggtgggggagtagtattgtggaaagaaaacaaacatttgtagagtattcgagcctatacactcatctcctttgtctgacttctctacacagtgacgaggagctggcagaaagtgggagtcctggtccccaaatgtccaggatgcagccaactcttctctgaagtgctccactatttccagtacttcatgtggcacagacaatatcctcaaaaaagcctagggtttctgattttcatattctcaatggagaaaatgaggaaggaatatttacagttcatttgaataaagacaatgaatacacccctttgcacaaaacagacccaaaggctggcgactctgacacctacatctttgtgagaagctcagagtgattccaaagtccctggagagcctctgcccaaagccgcactccagtcataagagttgagagagtgggatagagggacatctctgtaatgttcctgcctacttatgaaaatcaatacccacgtatgagaggctgtgtgggattatctaaagaagatactatactattctgtagataattgatctggaaaaggtggaatattggattggaaaatttcaaaatgttttctacccacttggagttcatcccatgcctgctcttgggatcttggttggatgatgcctttggggtagtccagaggaaaagagctgtgctgtggagatggggagccgggttacggtccaggttgtttcaaggaggaactgactgtgaggaaacaacacaactagcttttgtttcaaggtctgcttttatgaacaggtatctgtatgttagccattttggaagaaagagttgaacagccactgagggatggtagaaggggcactctaattctagttgtactttatttttactacatgctctgggcagcaaaacagactggaaaaataatcagctctaaagccaggcattcctgggtttgaatctgagatctcctgctgtaaagagtttgaccttagtcaaatacttttggcatttgagctttaatactttgtctataaaatgagggtcataatactatttttccagggttcttctgtggttaaaagactatcactaagaatgtcctggtttaatcagcactcatcagattaatgctatctatatcctgcattatcattgctattaaacctcacctgccaacccaaaaagctgtttggaggatgacatcacatactgggtgttcagactcttcagaaactgaaaaagacctgagccaatacaagaacatttttttgggagttaaaactcttggtctgtgacaaaaagatcaataaattgatcaataaattgatctgctatttctctgtagaaagatcacatgatttttttaaacaaaatgatgtcccctcagaaggggagatgttgggaggggaaagggagatgcaaaattacttgttgggtacaatgtacactacttgggtgatgggtgcactaaaatccttgaactcaccactatagaattcatctatgtaaccaaaaaccacgtttacccctaaagctgtgaaatagaaaaaaattttaaaaatgaggccagggtcataccattatttttttctctgagagagaaacagccaaaattatttcatttggaactcattagtacatttactcagcaaatgtttattttgtattatgatgtgataggcaatgatgtaatggaggaagtaccttattctccaatatagataagttttctgcacaaacggaggttttattcttctgtgggcagacaacacaaacaaagaaaaaaatgatttccaaatataagtgacatttggaaaacaaaatagggtaatgtgaaggagaatcatggtggttatggaggtcatttagtggtgacatttgagctgaatcttgaatgacagaaaaatgacaaaaccatttaagacctggggtaagaaagagttttcaaatgcaacaatggtccttaggcagagcatgtttgctgcatttatgacagaagctggtgttccctgaatatagtgagaaggagagtggtaggaaataatgtcaaaaaggtagttatggacttgaaaatacaaagccttgtaaatcatggttagattcagattttattctacatgtattgggaagtatttgactacctaatttatattttagaaggatcactcttcgtgctctggggaatggctcatagggttggcatggggagagactagggcacaaagacagttagaatttgcaggggacccagtgagacctgatggaggtatagactaggtggtagaagtgggaatgaagaaacatggatgaattaacttatattttggaggtaaaaaatagatcttaatgatgatttgtatatggcagatggggaaaaaaagagagtcgatgatgacttttaagtttttggcttatgtagttacatggaagatgagatagggaattctgagagaggaaatatttttgattatagtaggcaggtaaaagtgtcatttcagatatgttaagttagagatgtctataaggcattcaactgtagttgttgaccagggagttccatattgagcctggagctaacagaggacatagctggcctatgggatagtgttcaagccacgcattgaatgagatcacttagggaaagagtgtggatggagaagaggttcttaacctgagcacttggactgtcagttgaggtttaatagcgaaggaaaaatcagcaaaggagatcgaagtctattagtgaattggaagggaagccaatagaatgtgctgtcacagaaggcaaaacaagaaaatgtttcaaggagtggtcaattgtgtctactatactacttctgggtttgggtgggagcttatagtgtgaaaagaagaattagtcagaagagacagatggaaaataacttcaactggaaaggattaatgatataatccattagtgttcttattcctgcatttaaaattttcatgaaattttatatattgactttttttcttaatggcttctggcgttggtatcacttaaaaaggcctttgttgccttgctattataaataaccttcaatttatatttcttctataattatgttagtagctttgttttcatacatggaaactttgtggacaatcataaacttatttttagaatatggagtggagcagcgacccagttttatttttccccaatatttattgagcgacgcatcctgtcttcactaatctgaaattgcgtatttctctaagaatttgggtctctgtcttgcctctatctgtcctctcattgctatttgtgcacatattccatactcatttaattacttgacaaattatttgataaattatttcagtagtattggacccagtttatgtactttcctgctttaatttggccattgttttctgctcagtgttaccgctaatcctccgggaaaactgcctagtacaaactgcattctctaatctggagagagaaagttaaacttctgtaggaaaaagttgcctcaagtcatagttgcgtttgctgaggggcagggaccactgaagtggctctcctgatctctcatgttacttgcaggcaaaggagaatttaccatgaaactcctcatttcagaggcattttccaaaatttctttagtgggaggtcctgtaatgctgcagttcccaacctttttcgcaccagggactagtttcatgggagacaatttttccacagaccaagggagtgaggatgatttcgggatgaaaccattagctcatcaggaattagttaggttctcataagaactaggcaacctagatccctctcatgcacagttcaccgtagggtttgcgcttctatgagaatctaatgccattgctgctctgacaggaggcagagctcaggtaggttttatgatcagaaaaatattaaacaaaatttaacagccttggaaaagttatttataaacattgcattttatttaagaggttgaatatatacattgttttgccattttgaatttattagcagtgtggcaaagttagcttaatttgctattagtaaaactgaaaaccatttgataagctcttagaattatgctaatttgtctgaacggtagtagaagctattttaattaaaaactgtagctatatagtttaatctatatagtttaaccctcataatttgatagaattgagatcataggtgttgtgaagtatgactaatgccctaatataaataaacaagtaataaactgtcataaacagtctcaatatactctgaattctttcttccaacagatttaatttgtatagacaatagtaatacattcggataaaaattccaaatttgatttcacttatacttgttgatgtttgtaatgagagagtctttctgcgtatgttaaaattcatatgttaataggtgttttaaggagcttgtaaaaagagatgactatggaaacacataattaccctaaattttcatctttcatttgaaaacaaatttctcttaaatttaggatttttaaacaacctattatctgtctttgatcaaatggaaatttaatatatgtaaataggcaccgatgtttgcaagtaaacggcataaagagtggtaaagtaagttatgtgagggatgttttttaagtaacaagaagaaaaaatgttatgatttgtcggtaatatgtataaaataacactgtgaatatttgggaaatacacaaatgagaaaaaaatttaaaaatgctgtttgaaggttccaaacagtgacaaaatataagaatatactgcgggagatatgtcacttggacagaaacacactgagtgaagtccctgtatggtgtatggcacatggaaatgaagctcaagcagaaagcagctgtcttattggatttaggagtcagagtttggagttcggtgctgacagagtagctgaaattcaaggggggatccaggaaaagaaggattcacagtgtgaggagttacaaaatcttacaaagccacacttagttaggaactcggcaaaaataacaaaaaacaaataacccggctgggtgcagtggctcatgcctgcaatcccagcacttcgggagaaccaggcaggtggattggttgagcccaggagttcgagaccagtctgggcaacatggtaacaccctgcctctactaaacatacaaaaattagccaggcatggtggtgtgtgcctgtattcccagctactcaggaggctgaggcagaaagtacaactgagcctgggaggtccaggctgcagtgagccatgatggtgccattgcatttcagcctggtgatataagaaaccctgtctccaaaaaaaaaaaaaaacaaaaaccaaatatatatatatataaaatttattcacattatatatattttatatataaataaattattcatgtcctttactcactttttaaaccccataaaaaaagtgagtaaaggacatgaataattgtttaaaagaagacatagaaatggcaacaagcatatgaaaaaaggcacagcatcaataatcgttagagaaatgcaaattaaaagtaatgagataccatcttacaccagtcagaatggctattattaaaaagtcaaaaaaataacagacattggcaaggatgcagagaaaagggaatgcttatataatgttggtgggaatgtaaattaggatgacctctgtggaaaacagtatggagatatctcaaagcaataagaatatagctactatttgatccagcaatctcactactgagtgttattcaaagaaaaggaaatcatatcaaaaagatacatacattcatatgtttatcacagaagtattcacaatagcaaagatatggaatcaacctaattgtgggataaagaaaatatagtatatagacacaatggaatactattcagccatacaaagaatgaaatcatgtcttttgcagcaacatagatagaactggaagccattatcttaagtgaaacaactcagaaacagaaaatactgtatgttcttacttataagtgggaactaaataacgtttacacatggacacagagagtgcataatagacactggagagtctgaagggtgggagagtgggaggggggtaagagatgagaaattacttaataggtacaatgtacattattcaggtgatggctatactaaaagcctagactttatattcatgtataagaaatgcacttgtagctcctaaatttatacaagttaaaaaaaataaaactatcccttggttgattcttgagctgtgcaggcataagacaagactctaagaaagtaagtagaaaacagcagccagatggctgagagaaaagattttagcagttaccctcaactagggcaatagaattttaaatgcaagtgctgccaagtgaaagaggttgggtaaaaacttaggctttctaatgaaaacccagaaggaccacgccctaaaaataagaacaatactctgggactaaagggtataccctacaaataggtctataccctagaacaaggacatttaacaataaattaatgctgtgagtgtatgttatcagcagagtcatacttcaaaaattataaagtatttttgttaggtggtttgttgactgaagggaaatgatatcagatggaatttatgacccaaggaagtaataaagaacattaaaaatagtaactatgtggaaacattaaaaagagattacttttctaagtttttcaaaatacagttgacaaatgcaaaaataataacaatgtattacaccgttaataacatatataaataaaatcaacagcaataacacaaaaaactgaaggggcataggattaaactgttgtaagattcttgcattatgtatgaagctgtataatattaattcaagagagaatctgatgaactgaggatgcatatgataatctgtagataaacaattaaaaaaccaaagcaaaaaggtttagctaatagccaatgggggaaatagaatgaacgagtatagaaacttctcaaataaatcaaaagaagggagaataaagggcatattaacaaagactagaggaaaaacatagaaaatggattatcattgtagattcaaaccaaataaaaataattacattaaatgtaaatagcataaacattccaaataaaagggagattttctcaaactagacaaaaagacacaattgtatgtcattcacaaaaaatgtactttaaagacaaagatgagttgaaagtaagaggcaacctatgccatgcaaatagcaaccataagaaagctatgtgtctttattaatattaaataatatttgaaaatgaggggtgttatgagataaaagcgttatttaataataaacagagggtcacttgatcaagaagagataatattctctaaatgtttatgtactgatagtagagttataaaatatatgaaaccaaattaacagaattaaaggagaaataggcaaatctgtaatcagagttggagactgtaaggctcctctctagtaattgatagaacaagaagacagaaagtcagtaaaaatatacaaggctggaacaatcaactagatctaattgacatttatagagcactatacccaccaagtgcactatatacattcttttcaagtacacacagaacgttcatcaaacagaccatatttttagatgtaaaacagtctcaatagatttgaaaggattagaatcctacagttttctcaccacaatataattaatttagaagtcagtaacaaggtatacagtagaaaatccccaaatatttgcaaattaagcaatatacttctaagtcacccattgagaaaagaagaaattgcaaggaaagttagaagatattttgaagtaaaaaatgataaaatatagcccgggcgcggtggctcatgcttgtaatcctggcactttgggaggctgagttgggcggatcacctgaggttgggagtttgagaccagcctgaccaacatggagaaaccccgtttctactaaaaatgcaaaattagccgggtgtggtggcacatgcctgtaatcccaactactcgggaggctgaggcaggagaatcgcttgaatctgggaggtgaaggttgcaggtgagccgagattgtaccattgcactccagcctgggcaacaagagtgaaactgtctcaaaaacaaacaaccaatcaaaacaaacaaaaaaccccttaaaatttcacagaaaaattctaggctcaggtagcttcaaaggtgagttgaatagaacatttaatgaagaattaattctaacccaacacaaaacagaaaatagaaggagggcagtccggccccatctgtagtcatccacattgaatcatcagcatcagcatcaccttggaatttgttagaaatgcagagtcttaggccaaactccagttctggtgattcaggattctcattgtagcacagttcctgaatttgtacattttgttaagcaatgtggtcctgaagtgaggaagtaaacagaatgatgaagggaggtgggaaaaatatttttttcaagttctagtttttttttaaaaactagttaattgttttattttgttgagactctaaacttaccttagattcaatttttttaaatttgtgagtgagattgggctagaacagtggttcccctgtgggagcaattttatccttcaggggatattttggaatatctggagatattttttattgtcgtacagagagttgaaactggcatttagtggagagaggtcagagatgctctaaacatcctaaaatggacaggagagcttccaaccaagaattattttgtacaaatgttagtgctaatattgacaaactgtggactacagaatcctaagggtcctaatagctctgaaactctgggatccaatttaactgaaaaaacattcactgaatactgtgtgccaagttattatggtcttacattggtgtgccagcggggagacactgtcccatagcatgggcatacactatctggcccctaaccatgtataagaccattgatctatgccaaccagacaatacatgttcagaattttgaaaagaataggaaagctagggtcagccactctcatactacaaggaaatcagtaattcactctctgacataagtaagagtaggccaaggactgtttataactaacctcatcactcaggtgtactttctatttcatattattaataacaaattatactcattatcctgtatttataaatataatgtgcatcacatacagagtgaaagaaaaaatgaccaagggaaagaaaaagtagataaattgggagcaaaatgaacattgcttatgcatattgaaatccatgtcagtactagaaaataaagctattccatgccattgtttttgacaataaggcaacattttatgaaaaaatcataggggtagaaatttttccagaccataattgtgagtagagttatagtaaataggtggaacagaagcagaccacctaacgactagtattttcaactctgcatgctatatatccgaaggacagatattgacctaaactgttaagaaaagttcaaggaaaatgcaactaagaaatatgataaaggatctgggaattatatgatatgatgaatgagtaaaaggataaaacaatttaaatgaaaactttaaataaatacatttgatgtatataaatctaaatacattttgtaatatgtacatatctttgtattttaggaaagtgattctgtataatcacacttgagatatattagttatgccatgcagatgaggaattagattaattttctacattgcttggagatctactaagtcaaagcacagggaagggactccaacttgtgaaaaacagtcagaccaagtttccctggacggagagtaaatttgccattgtcagtttcctacatatattatgctactaacaggcattggttttatgcttacttatatttattattacaggaatgaatcagaaagactaaagaaattaaaatagatgatgtagggtttggatagaaaatttaaaatactgaaggactttatcacaggggaatatccaaacaatgattttagcaatagacaataaaatcgagggaaaagtttttgggtctgaaatctgagttagcagtgcccagggtaacaggaggggaaattccactacagatcattcattattcagtgatcacatttgaggacaagccactcattctgacaataggaataagaatacacttggaaaaggtgtacatttgtttacattatctcaatctgtagtctgatgtttcctgagatgtttcctcttttatgtcaatactttgcaataagtaagccacatatccgtaatttcagatgatctgttcttccagaggaaaatatttcagagtgcatgtcagatttttcatcacaatctataggctaaactctttcctttcattagaccaatattattaactcatggaagcctttctccctccttttatcttttattgtataatttagtcattttgaagaaaacaacactcatgttttgacctctggcactgtcaatttcctgggaatggcaagaacaggaacaaggccaggcttggaggagcagagcctgagatagcatgcatctgatatatttagtgaacctgtcttactccaatttttgtgcttaaatgctagcttcagaaagagttttcctctgtgagtgctgaaacaggatggctaatttggctgattgattttctggccaattcaaaaaatagtagagggataaggaggaaacgttttatacctcagtagctttgtagactgaatcatggcattttcttaatttcaagaagactgtcattaataaacacgaaaaacctctaacttcttcaaatatatttaacgtgactcagtagtgtgccgagaagatgcaatggaattctaaaacctacgtttgcactttttctgtctgctaatccacataatttctgactggaggtacacttggaatttactttatttggccttctgctgtttgatgtgccagaatctcccacagatacaggataattggtttagcgtttggggatctggccacaaggtggcagagcttctctgctcatgtagaatgtacgaaaggatccttttggttgacttctgtgagtaggctgacggcagaagcagatgcctctgtggacagtttaagaaaccacagtgctttggaggaaaggaagagatacttgataatatagctctcttggctggagattgcaggtcccagtggggagaacaatgaagacatttgctggattttcgttcctgtttttgtggctgcagctggactgtgagtcgagagcttttggggaacagagggtttagtaaatactcattagaagtctgaggaggagactcatctggtcttttccagaatgtctgaagttactacagtgaaaaaaataaaaaagcaaactccagagaatgatggcctgatgatcttgtctgacttttccttttgcacaggtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagtacacattgcttctcaggcacctgtatcctgtacccaaacctgcacctgggactaaagccacactctatttcctttacctttaagtcagggattttgctgtaaggtatttttaatgtacggacattacaaaacatcctaaaaggtcagtttcaaaatgacttaatgattttcagaacattttgattaaactctttttgggagttaatgatttcttagttgatatcctggtcttagggttgactttatgggtgccataaagtcatctgaatgatttctcccctaccaaggacatcttggtgtcagagaatcctctccttgatggagtcttttatcttttaacattagtatttattaactttttctaactataaatatattaagtgcacggtataggaaaaaacaggaaattataaaatagaaaatcaaaatgtcttataatcctatcatacacataattcatagctaacatttagtattccttcttcattaaaaaaaaaattaggatcgcttttcctgtggcagcagctggggtgagaagagcagtggctctctcctctctctgccatggcatgtgcttgcccactgatgtcagcgtactctgagaagggagagtcatctggcaaaaatgtcactttgtctgccatattcaaggctcctattcgaccagatattgtgaactttgttcacgccaacttgtgcaaaaacaacagacagccctatgctgtcagtgaatcagcaggtcatcaaaccagtgttgagtcttggagtactggcagagctgcagcttgaattcccagagttcgaagtggtgggactcaccattctggccagggagcttttggaaacatgtgtcgtggaggctgaatgtttgcaccaaccaaaacctggctccattggcatagtagagtgaatacaaccccaaaacgatatgtcatctcttctgccctggctgcctcagccttaccagcactggttatgtctaagggtcatcgtattgaggaagctcctgaacttcctttggtagtcgaagataaagttgaaggctacaagaagaccaaggaggctgttttgcttcttaagaaacttaaagcctggaatgatatcgagaaggtctatgtctctcagcaaatgagatccagcaagagcaaaacgagaaaccatcaccgtatccggcgcaggggcgccgcatcatctgtaatgaggataatggtatcgtcaaggccttcagaaacatccctggaattactatgcttaatataagcaaactgaacattttgaaacttgctcctggtgggcatgtgggacatttctgcatttggactcaaagtgctttctggaagttagatgaattttctggcacttggcataaagctgcttccctcaagagtaactacaatcttcccatgcacaagatgatcaatacagaccttagcagcatcttaaaaagcccagagatccagtgagcccttcgagcaccttgcaagaagattcatcgcagagtcctaaagaacccactgaaaaatctgagaatgatgttgaagctaaacccatacacacagatcatgcgccggaacaccattcttcgctaggccaggaatcacaaactctgggtggataaggcagcagccggcagcagcagcactagaagccagatcagatgagaagggggttgtaggcaagaagcctgtggtatgtaagaaaggaaagaaggccattgttgatgttaagaagcagaagaagcctctggtgggagaaaaggcagcagctaccaagaaaccagcagctgaaaagaagccggcaaaaaagaaatctactacggaggaaaaggagcctgctgcataaactcttaaatttgattattccataaaagtcaaatcattttgaacagcttcttttgaataaagacctaatcaaagaggcagtgaggaaaaaaaattaggatcactcagacttgtattttaatttaatagtatattctaaccttaatgtttcacatttccccaatcttataaaaataaatttttaaatgattttgtgagtgattttataagccagcattttatttccactataatcgtcccatatatctgtggtgaaagacagtatttttctgaactcaggtgttaccctttaaatagtttcttacatgtaggaagttttaaattttctagaaatttattttttcttctgttctagaaataatttgtttcttcaatcacttatgctcttttcctcttgttctttcttcctccttgaagtgctgaatgttttcatttgtcccattttttttctatttttcacagcattttaaagggaaagttatatgtttctaacattgtatgttaaggtttctttcagcactgatgatactgggatttattaaatcttccaggagcagataaggaggtcagggttgatttagaattatttgccaagccagaagtcaggatgtcttttgctagtacgaatggtacatcacttatatttagatgccagttggagaacttgctggagaggtccatagtgatatccacttctgtgcctgaattgcttttatattaccatctctttgtatgattgtatcattctaacagggagagtagtttggtgacctatgttcagtggtttggttccttaaaaatgacaacgatgctatttggtattcctctaatggcatgcaaacaaaccatagtttctttttgtttttgttttttttttttttgagatggagtctcgctctgtcgctcagtggcacaatcttggctcactgcaagctctgactcttgggtttatgccattctcctgcctcagccttctgagtagctgggactacaggcgcccaccatcaggcccggctaattttttctattttttggtagagacggggtttcaccgtgttagccaggatggtcgcgatctcctgacctcatgatccacccgcctcggcctcccaaagtgctgggattacaggcgtgagccaccgcgcctggccgtttgtttctaagattaaaaattttgtttaaaaacagatgtttactttctgaaatgccttatagagatagttggtgtttagtttttcactttgtactcgttatcatcatcatcatcaccatcatcatcaagtggaagctaattcttcctcatataattcatgatcagaattaccctttattattttactctttgatctctttctactccccaggacccctgccactgctttataagtgttagtctaattgctcatttgtccttagagctgtctcaggtgagcttttatcatgtaggcagtaacacatgggttgattggactatccttcaagtctatcttctttataatatgtttaaaaagttgctcagtttttagggctatgacttgtgccactccttgcatctggcacttgtgtgtatttcaccgtttttaatgttttaccaatggacatttaaggaaaggggctaggtaaaatgcactgaatacacagatccatcaatatgtttgaaataatgcatgtgaagcacctagcatgatcctggcatgtactcatcattatttaataccaaatgggtactgacatatcagcagacttcatcctcaatatggatgtagctagataaaaaccaacagaatgtagctttctcttatttctggctcggtgtttcactttttctggtatcatgatgcccactaaattgaacatgtccaaaactagaatatgtcttttaaattttatttatttatttacttatttattttgagatggagttttgctctgttgcccaggctgcagtgtaatggtgtgatcttggctcactgcaacctccgcctcctgggttcaagcgattctccttcctcagtcttctgagtagctgggattgcaggtgcctgccaccatgcctggctaattttgtatttttggtagagacagggtttctccatgttggccaggctggtcttgaactcctgacctcaagtgattcacctgcctcggcttcccaaagtattgggattacagttgtgagccactttgcctggccaatatctgtctttttaaaaataagttttttgatatagacttggcaagatggctgaataggaacagctgtggtctgtagctcctagcaagattgacacagaaggtgggtgatttctgcatttccaactgaggtacctggttcatctcactgggactggtcagacagtgggtgcagcccacagagggcgagccaaagcagggtggggtgttgcctcatctgggaagcagaaggggtcagggaactcctttccttagccaagatagccatgagggactgtgccgtgaggaatggtgcactccagcccagatactgcacttttcccatggtattcacaacccacagacccacaggagatttcctccggtgcctatgccaccagagccctgggtttcaagcacaaaactgggtggctgtttgggcagacactgagctagcttcagaattttttttcatacgctagtggtgcctgaaacgccagcaagacagaaccattcactcccctggaaagggggctgaagccagggagccaagtggtctggcttagcgggtcccaaccccacagagcccagcaagctaagattcactggcttgaaattctcgctgctagcacagcaatctgagttcgacctgggacactcgagcttggtggggagacgggcgtctgccattgctgaggcttgagtaggcggttttacccttacagtgtaaagaaagccactgggaagttcaaacttggcagagcccaccacagcccagaaaggctgctgtggccagactgcctctctagattcctcctctctggcagaccatctctgaaaaaaaaagcagcagccccagtcaggggcttatagataaaacccccatctccctgggacagagcacctggggaaggggtggatgtgggggcagcttcagcagacttaaatgtccctgtctgatagctctgaagagagcagtggatctcccagcacagtgttcgagctctgcaaagggtcaggctgtctcctcaaatgggtccctgaccccgtgtctcctgactgggaaaacctcccagttggggccaacagacacctcatacaggagagctctggctggcatatggcaggtgccctctgggacaaagcttccagaggaaggaacaggcagcaatctttgctgttctgcagcctctgctggtgatacccaggcaaacagggtcaggagtggacctccagcaaactccagcagacccggagcagagaagcctgagtgttagaaggaaaactaatgaacagaagggaatagcatcaacatcaacaaaaaggaagtccacttacagacccctatctgaaggtcaccaacatcaaagaccaaaggtagataaatacacaaagatggggagaaactggcataaaaagtctgaaattcaaaaaaccagaacgcctcttgtcttccaaaggatcccaactccttgccagcaaggcaacaaagctggacaatgagttttacaaattgacagaagtaggcttcaaaaggtgggtaaaaacaaactcctctgagctaaaggggtatgttataacccaatacaaagaagctaagaatgttgaaaacacgttaggtgaattgctaaatagaataaccagtttagagaagaacataaatgacctgatggagatgaaaaacacagaatgagaacttcgtgaagcaaacacaagtatcaatagccaaatcaatcaaggagaagaaaggatatcagagattgaagataaacttaatgaaataaagtgagaagacaaaattagagaaaaaagaatgaaaaggaacaaacaaagcctccaagaaatatgggactatgtgaaaagaccaaatttacgtttgattggaatacctgaaagtgatgggaagaatggaaccaagttggaaaactcttcaggatattatccaggagaacttccacaacctagaaagacaggccaacattcaaattaaggaaatacagagaacaccacaaacatactcctcgagaagagcaaccccaagacacataatcatgagattcaccaaggtcaaaatgaaggaaaaaatgttaagggcagccagagagaaaggtcgggttacccacaaagggaagcccatcagacaaacagcagatctctctgcagaaaccctacaagccagaagagagtggggccaatattcaacattctttttttttttcatcatttcagctttattttatattacatcaaaattatgtttttgaaactttatggagaccataaaacattcgctttcaaaaaattacccttgttgcctatagtgtcttctccataggcatattctacatgtgttttatgatttttttttattttattattattattttttattatgctttaagttttagggcacatgtgcacaacgtgcaggtttgttacatatgtatacatgtgccatgttggtgtgctgcacccattaactcatcatttagcattaggtatatctcctaatgctatccctcccccctccccccaccccacaacagtccccggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctttttaatgatcaccattctaactggtgtgagatggtatctcattgtggttttgatttgcatttctctgatggccagtgatgatgagcactttttcatgtgtcttttggctgcataaatgtcttcttttgagaagtgtctgttcatatcctttgcccactttttgatggagttgtttgtttttttcttgtaaatttgttggagttcattgtagattctggatattagccctttgtcagatgagtagattgcaaaaattttctcccattctgtaggttgccggttcactctgatggtagtttcttttgctgtacagaagctctttagtttaattagaatcccatttgtcaattttagcttttgttgccattgcttttggtgttttagacatgaagtccttgcccatgcctatggcctgaatggtattgcctaggttttcttctagggtttttatggttttaggtctaacatttaagtctttaatccatcttgaattaatttttgtataaggtgtaaggaagggatccagtttcagctttctacatagctttctacagctagccagttttcccagccccatttattaaacagggaatcctttccccatttcttgtttttgtcaggtttgtcaaagatcagatagttgtagatatgtggcattatttctgagggctctgttctgttccattggtctatatctctgttttggtgccagtactgtgctgttttggttactgtaaccttgtagtatagtttgaagtcaggtagcctgatgcctccagttttgttcttttggcttaggattgacttggcaatgcaggctcttttttggttccatatgaactttaaagtagttttttccaattctgtgaagaaaatcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgcagaggtccttcacatcccttgtaagttggattccgaggtattttattctctttgaagcaattgtgaatgggagttcactcatgatttggctctctgtttgtctgttattggtgtataagaatggttgtgttttttgtacattgattttgtatcctgagactttgctgaagtagcttatcagcttaaggagatcttgggctgagatgatggggttttctaaatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtgtttgcccattcagtatgatattggctgtgggtttgtcatagatagcttttattattttgagatccatcccatcaatacctaatttgttgagagtttttagcgtgaagtgttgttgaattttgtcgaaggccttttctgcatctattgagttaatcatgtggtttttgtcattggttctgtttatatgctggattacgtttattgacttgcatatgttgaaccagccttgcatcccagggatgaagcccacttgatcatggtggataagctttttaatgtgctgctggattcagtttgccagtattttattgaggatttttgcatcgatgttcatcagggatattggtctaaaattctcttttttttgttgtgtctctgccaggctctggtatcaggatgatactagcctcataaaatgagttagggaggattccctctttttctattgattggaatagtttcagaaggaatggtaccagctcctgtttgtacctctggtagaatttggctgtgaatccatctggtcctggacttctttggttggtaggctcttaattattgcctcaatttgagagcctgttattggtctattcagggattcaacttcttcctggtttagtcttgggagggtgtatatgtcgaggaatttatccatttcttctagattttctagtttatttgcgtagaggtgtttatagtattctctgatggtagtttgtatctctgtgggatggaaggtgatatcccctttatccttttttattgcctctatttgattcttctctcttttcttctttattagtcttgctagcggtctatcagttgtgttgatcttttcaaaaaaacagctcctggattcattgactttttgaagggttttttgtgtctctatctccttcagttttgctctgatcttagttatttcttgccttctgctagcttttgaatgtgtttgctcttgcttctctggttcttttaattttgatgttagggtgtcaattttagatctttcctgctttctcttatgggcatttagtgctataaatttccctctacacactgctttaaatgtgtcccagagattctggtatgttgtgtatttgttctcgttggtttcaaagaacatctttatttctgccttcatttcgttatataaccagtagtcattcaggagcaggttgttcagtttccatgtagttgagtggttttgagtgagtttcttaatcctgagttctagtttgattgcactgtggtctgagagacagtttgttataatttctgttcttttacatttactgaggagtgctttacttccaactatgtggtcaattttggaataggtgtggtgtggtgctgagaagaatgtctcctgttgatttggggtggagagttctgtagatgtctattaggtccacttggtgcagagctgagttcaattcctggatatccttgttaactttctgtctcgttgatctgtctaatgttgacagtggggtgttaaagtctcccattattatggtgtgggagtctaagtctctttgtaggtctcaaggacttgctttatgaatctgggtgctcctgtattggctgcatatatttttaggatagttagctcttcctgtggaattgatccctttaccattatgtaatggccttctttgtctcttttgatctttgttggtttaaagtctgttttatcagagtctaggattgcaatccctgcattttcttgttttccatttgcttggtagatcttcctccatctctttattttgagcctatgtgtgtctctgcatgtgagatgggtttcctgagtacagcacactgatgggtcttgactctttatccaatttgctagtctgtgtcttttaattggagcatttagcacatttacatttaaggttaatattgttatgtgtgaatttgatcctgtcattatgatgttagctggttattttgctcgttagttgatgtagcttcttcctagccttgatgatctggcaacagagccagaccctgtctcaaaaaaaaaaaaaagtaaaacagtaataaataaatagatacatatacagaagatacaaggagacaacttgcacgaggaaaagccacatggttcacaaacatatgggaaatgtttaaacctactggtattcacaaaagtgaaagcaaataacttaaaaaacctatcaaggaagaggaccaaataggaacagctctggtctacagctcccagcgagattgatgcagaaggtgggtgatttttgcatttccaactgaggtacctggttcatctcactgggactggttggacagtgggtacagcccatggagagtgagccaaagctggatgaggcatcgcctcacctgggaagtgcaaggggtcatgggagatttccctttcctagccaaggtaagctatgacagactgtacctggagaaatggtacactcctgaccaaatactgctcttttcccacagtcttagcaaccagcagaccaggagataccctcccatgcctggctcagtgggtcccatgaccacagagccttgcttactgctagcatagcagtctgagattgacctgcgatgctgcggcttgatggggggacgggagtctgcccttgctgaggcttgagtagctcacagtgtaaaccaagctgccgggaagcatgaactgggcagagcccaccacagctcagcaaggcctactacctctacagattctacctctaggggcggggcatagtagaacaaaaggcagcagacagcttctgcagacttaaacgtccctgtctgacagctctgaagagagcagtggttctctcagcatggcatttgtgctccaagaatggacatatggcctcttcaagcaggcccctgacctccatgtagcctgactgggaaacccctcacagtaggggctgagagagtcctcaaacaggctaatacccctctgggacgaagcttccagaggaaggatcaggcagcaatatttgttgttctgcagcctctgctggtgatacccaggaaaacaggatctggagtggacctccagcaaactccaaaagacctgaagctgaagggtctgactgttagaaggaaaactaacaaacagaaaggaatagcatcaacatcaacaaaaaggacatccacaccaaaaccccatctgtaggtcaccaacatcaaagaccaaaggtagataaaaccacaaagatggggagaaaccagagcagaaaagctgaaaattctaaaaaacagagcacctcttctcctccaaaggattgtagctcctcgccagcaagggagcaaaactggacagagaatgagtttgactagatgacagaagcaggcttcagaagatctgtaataacaaacttctttgagtgaaaggagcatgtcctagtccatcacaaggaagctaaaaaccttgaaaaaaggtttgatgaatggctaactagaatacacagtgtagagaggaccttaaatgacctgacggagctcaaaaccatggcacaagaacttcatgatgcacgcacaagcttcaatagccaattcaatcaagtggaagaaaggatatcagtgattgaagatcaaattaatgaaataaagcaagaagataaggttagagaaaaaagagtgaaaagaaatgaaaaaaggcttcaaaaaatatggactctgtgaaaagaccaaatatatgtttgactggggtaccggaaagtgacagggagaatggaaccaagttagaaaacactcttcagggtattatccggcagaacttccccaacctagcaaggcaggccaacattcaaagtcaagaaatacagagaacaccacaaagatactcctcgagaagagcaacgccaagacacataattgtcagattcaccaaggttgaaatgaaggaaaaagtgttaagggcagccagagagaaagtctgggttacccaaaaagggaagcccatcaaactaacagtggatctctctgcagaaaccctacaagccagaagagagtgggggccaatattcagcattcttaaagaaaagaattttcaacccagaatctcatatccagccaacctaatcttcataagtgaaggagaaataaaatcctttacagacaagcaaattctgagagattttattaccaccaggcctgccttacaagagctcctgaaggaagcaataaacatggaaaggaacaagcagtacaagccactgcagaaacatactaaatggtacagatcatcgacactatgaagaaactccatcaattaacgggcaaaataaccagctaacatcataatgacaggatcaaattcaaacataacaataataaccttaaatgtaaatgggctaaataccccagttaacagacacagactggcaaattggatagagtcaattccaatcagtgtgctgtattcaggagacccatctcacatgcaaagatgcacataggctcaaaataaaggaatggaggaagatctaccaagaaaatggaaggcaaaaaaaagcaggggttgcaatcctagtctctgataaaacagacttaaaccaacaaagatcaaaagagacaaaggaggccattacataacggtaaagggatccatgcaacaagaagagctaactatcctaaatatatatgcacccaacacaggagcacccagattcataaaacaaattcttagagtctaccaagagacgtagactcccacacagtaatagtgggagactttaacacctcaccgtcaatattagacagatcaatgagacagaaagttaacaaagatatccaggacttgatctcagctctggaccaagtggacctcatagacatctacagaactctacaccccaaatcaacagaatagacattcctctcagcaccacatcacacttattctaaaattgaccacataattggtagtaaaacactcctcagcaaatgtaaaagaacagaaattataacaaactgtctctcagaccacaacgcaatcaaattagaactcaggattaagaaactcactcaaaactgctcaactacaaggaaactgaacaacctgctcctgagtgactactgggtatataacgaaatgaaggcagaaataaagatgttctttgaaaccaacgagaacaaagacacaacataccagaatctctgggacacatttaaagcagtgtgtagagggaaatttatagcactaaatgcccataagagaaaacaggaaagatctaaaattgacaccctaacatcacaactaaaagaactagagaagcaagagcaaacacattcaaaagctagcggaaggcaagaaataactaagatcagagcaaaactgaaggagatagagacacaaaaaacccttgaaaaagtcaatgaatccaggagctggttttttgaaaagaacaacaaaattgatagactgttagcaagactaataaagaagaagagagagagaaatcaaacagacccaataaaaatgataaaggggatgtcaccactgatcccacagaaatacaaactaccatcagagaatactacaaacacctctacgcaaataaattagaaaatctagaagaaatggataaattcctggacacatacaccctcccaagactaaaccaagaagaagttgaatctctgaatagaccaataagaggttctgaaattgaggtaataattaatagcctacaaaccaaaaaaagtccaggaccagatggattcatatccaaattctaccagaggtacaaggtggagctggtaccattccttctgaaactatttcaatcaatagaaaaagagggaatcctccccagctcattttatgaggccagcatcaacctgacaccaaagcctggtagagacataacaaaaaagagaattttaggccaatatccctgatgaacattgtgcaaagatcctcaaaaaaatactggcaaaccaaatccagcagcacatcgaaaagcgtatccaccacgaccaagtcagcttcatcccagggatgcaagactggttcaacatacataaatcaataaacacaatccatcagataaacagaaccaaagacaaaaaccacatgattatctcaatagatgcagaaagggccttcaacaaaattcaacagcccttcatgctaaaaactctcaataactaggtattgatggaatgtacctcaaaataataagagctatttatgacaaacccacagccagtatcacactgaatgggcaaaaactggaagcgtacactttgaaaaccagcagaagacaaggatgccctctattaccactcctattcaacgtagaacactatgttggaagttctggctagggcaatcaggcaagagaaagaaataaaggatattcaaacaggaaaagaggaagtcaaattgtctctgtttgcagatgacatgattgtatatttagaaaaccccatcatctcagcccaaaatctccttaagctgataagctacttcagcaaagtctcaggatacaaaatcaatgttcaaaaatcacaagcactcctatacaccaataatagacaaacagagagtcaaatcatgagtgaacccccattcacaattactacaaagagaataaaatacctaggaatccaacttatgagggatgtgaaggacctcttcaaggagaactacaaaccactgctcaaggaaataaaggaggactcaaacaaatggaaaaacattccatgctcatggataggaaggatcaatatcgtgaaaattgctatactgcccaaagtaatttatagattcagtgctatccccatcaggctactactgacttttttcacagaattggaaaaagctactttaaatttcatatggaaccaaataagggccctcatagccaagacaatcctaagcaaaaagaacaaaactggaggcatcatgctacctgacttcaaactatattacaagcctactaaaacagtagtactaaactacagtttagtaactaaacagttagtacaagtaactaaaacagcatggtactggtaccaaaacagatatatagagcaatggaacacaacagaggcctcagaaataacactatacatctacaaccatctgatcttagacaaacctgagaaaaccaagcaatggggaaaggattccttatttaataaatggcactgggaaaactggctagccacatgtagaaagctgaaactgaatcccttccttacaccagatataaaaattaactcaagatggattaaagacttaaatgtaagacctaacaccaaaaaagccctagaagaaaacctaggcaataccattcaggacatagcatgttgtacgtgttgacataggacaagacttcatgactaaaacaccaaaagcaatggcaacaaaagccaaaattgacaaatgggatctaattaaactaaagagcttctgcacagcaaaagaagctatcatcagagtgaataggcaaactacagaataggagaaaaactttgcaatctatccatctgacaaaggactaatatccagaatctacaaggaacttaaagaagtttacaagaagaaaacaaacaaccccatcaaaaagtgggcaagggatatgaacagacacttctcaaaagaagacgtttatgcagccaacagatgcatgaaaaaatgcacatcatcactggccatcacagcaatgcaaatcaaaaccataatgagataccatctcacgccagttagaatggtgatcattaaaaagtcaggaaacatcagatgctggagaggatgtggaggaataggtacgtttttacactattggtgggagtgtaaattagttcaaccattgtggaagacagtgtggcgattcctcaaggatctaaaactagaaataccatttgacccagcgatcccattactgggtatatacccaaaggattgtaaatcatgctgctataaagacacatgcacacgtatgtttattgcggcactgttcacaatggcaaagatttggaaccaacctaaatgcccatcaatgatagactggattaagaaaatgtggcacatatacaccatggaatactatggagccataaaaaaggatgagttcatgtcctttgcaaggacatggatgaagctggaaaccatcattctcagcaaactaccacaaggacagaaaaccaaacaccgcgtgttctcactcataggtgggagttgaacaacgagaatacgtgaacacagggcagggaacatcagacactggggcctgttgtggggtgggggtctgggggagggatagcattaggagaaatacctaatgtaaatgacgagttgatgggtgcagcaaaccaacatggcacatatatacctatgtaacaaacctgcacgttgtgcacatgtaccctagaacctaaagtataattaaaaaaaggatcaaaagcttttttaaaaaaagaaagaaatacttgtatttgtatgcagtgttaaaaaaaaaacaaaaaaaattaggaaattatagaaatagcaaatcgaaagggagataatttggaaaaaatgcagtgaaacatactgctctggtgggagagtaaacttgtaagccattttaaaaagtaatttaaaaacatgacaataatctaaaaaatattcattttcttcattgtaatgattttctctagagaatctgtcttcaggaaaactctaaatgcatataataattatttacaaaggtatttggaaagttatgtacactaccccaaaatggaaaaccaaaatgtctcatctttaagggaaaggcttaatgacacaaatggaatattatgcaccaaataaatggtgtttacaaagataatctacaatgattattgaatagtaatgattattgaatagtaataattaaaaagaatcaagatatcgttgccacttaataaaaatctgaatagtgcaaatgttgggaaaaacgcactgagatattgataatgcatatctttgcttgataaggtaagtagtgattttctctttcatcctatttttatcagttttccaaaatatgccttagttgattaaaagtctttccaatccaccattttctgtaaattttgtaaaattactcttagctctgaagttcaatgaccctggttcagtcacctatacctcacaatgagaaagcagcaataacctcctgactggttttgcagccactattggattccttttcttatattaatagttcatatttattcagttcttactgtgtctgatgcattatataaagcattttatatacattagccaatgcattctagtgatatcccccattttacagataaggaaattcatacttagagacattaagtagcttgctctagctcactcagagattaaatggaggagtttcaaagccaggtttgtttgaggctggaatacaaactcttaactattctttcatgatgtctatcaacatacttctccaaattattcttgtagataagcagcctaattaatagaatgttaacagaatagaatgtccagtatatggacttccattttcataatattacctcctctaaagcctcaaaagttccttgtttgctaacaaataacctacaaatgaatcctggcattcaaaatcttttgttttctagacctgaattctccttccaacttgattttctgctacattctagcccattctctctttcttctatctgtccatccatctgttcagctgtcattgatctctccatggaatggcataaatgcatctaaggaagtgactacaatacatccatcctggcattaaaaagtagaaaagaaaggatttctgatatatataatcagagggctgctgtattttaaaaataattttaaacaccctctcagagggtattctaggggtaaaaaacccttcactcgtttgaattctcgctgaatttaaactgaatgtctacttattatagcccaacaagataaagaaaaaaggccttttgaagtcaaagcaatacttttttttcacctgtgggaaggcctattccctagatctgggaaagtttcctagaattcagccatacattttctgtgttttacattatctagagcacatgacatctgcaactgtggcaagaaggacagagtagttcaactgggcaatgaaatggagaacttggaaaacttgatcatttgacctgtatccagaattaatattgtcaattccatgttatgtactgagactcaattagcattcttctggacttgttacttacaagtgtggtctgagaaccaactgtatcagcatcaccagtaaacttgttaaaatgtggaatatccagccccacctcagacctaatgaaacagaattcacagcttaacaaaatccccaggtgatttgcatacataattaagttttagaagccctgacctgggagcacgttccattattataacaactttctgaacacaagagggcagtatttcctaccccctcagagcctgtctcagatgtgaaccgaagttcactgcatagctggattaggccagtatgtgtaaggggctgaacaggcttgccattgattggctggataggaaggccagaacttccttctaggggtagaagaaccccagtaacacctatcaaactaaacagaatggctttttggctgagaagcctgggtctacatttcaggccacatttggggagacgaatggagtcattcctgggaggtgttttgctgattttgtggcttcaagtggactgtgagttggagatttcctgttgatggagacagagagatccagggctgcagtgcacaggatgaaggggaggggctaggatccattcttccccatctttggttatatctggggttgtgggaggaaaatagactcaacagtgtcagtgtagtgactaaccctcctacttttggtgttgtgtttctgcctaggggtgaagagccaaaagatagaacagaattccgaggctctgaacattcaggagggtaaaacggccaccctgacctgcaactatacaaactattctccagcatacttacagtggtaccgacaagatccaggaagaggccctgttttcttgctactcatacgtgaaaatgagaaagaaaaaaggaaagaaagactgaaggtcacctttgataccacccttaaacagagtttgtttcatatcacagcctcccagcctgcagactcagctacctacctctgtgctctagacacacagtagtgccctggcagctgcttcctgcacccaaactctgctaactctcacaatcagagctcatggctgtgctgtctcccaaaggctaatcacagctcctgacagaatgggggggtgttagttgaaagggcaattttcaaaacaaacaaacaaatgctctgaagaattcctcagagaaaggagggaggacttgcttttaaaaaatgcataaattctgcttagtttttgtgactagcctagagcagcgtgataaatttatggagttaaacacattacacttaagcattaaaacatggattcttctagatgaaaaaataatccaaacatttttgagtcccttcccaaactgaacactgaataatgatgatgatgatgataatgataaaaaattgacctttttaaaaattgttcatcttatgaatggataaccatgctatattggaaaacatgccataagtcatggcattgcagagataaatttagagccgttgtttactatgtatgtggtatcagtgagtaggtcaatatacaagtcttctttttcatttgtttcttaagagacagggtcacactctgtcacccaggctggaggctggagtgcaatagcacaatcacagctcactgcagaccacaactcctgggcttaagtgatcctcctgcctcagcctcctgagtagctggaattacaagcacacaccaccatgcctgggttgtacaactcttttaagaaagagaacttacaccttctcatgttaggcatgggttctgagttgaggacttctccgttattattgcctgcattgccatttctatcaatttctgtcatctatgtattaccttatttcttgatctatttttagattattgccaaaacagacagatcccataggtcatgcatgttcagttactaacatggcagaatctgtgggttttgactaactctgttttaggctagggctgatatttctgtctgctttgggccacatacagtcactgccaaaatgatatgatcatgaagctgtttgtgtttgagtgtaggaagaggtgcagagagaatatatgtaggataataggggaagaaaacaatacacctagaaaaacagaatttgaggacaagaagtcccttcttttaatcaccattaataaaatagaggcagctaggaataagaaaataatgggctctgagtcactggcatctgggatttgatagtcagagagaaggagagttcaatgcagagattgttaaccatagttggacatcttgaaggttcataaactccctgaaattgagaatagatgaaatattattatgacataattattgtttgggaggagttttcctcccatttctggcaatgaacaagaaaagattcatataatttgaatatggataagagttatgtcagaacagggggctgagagaaggatgagggattgttcaacagctcaggccagagatgaggacagacctaagaaatgattgaatgtaggagaatttagaagggagtaaataattttctccaacaggaattggaatgtctttccctttgtaataaatggagggtataaattacaactggcagtacagcattcaaaagtatgggcgtgggagtgcaacatatcggtggaaaattctgacccagtcaatgactgggctgtgttgtcttggggaagtgtttctagatctctgagtaccaaattcctctcctgtgaaatgctagtaatagaattacctcataggattattgttaatatgtttatacatattaacataaacatatgtatatgtttatacataaaagtataaaaatatatataaggcaactattgtggtggcaggtacaccagtgcactagaaattcaacagacacttgtttatagttcatttctttcaggaagttaaaactcaaattttctgctctaagcattaaatatatctttttcatgttctatttctgtaatctttttactaatcacctcaaaatctatttgaaatgatttggtatgtaaatatataaatgatctgtgtttcacaaaccagagacattaacaaatattattgagtacctgctatgtgccagacactgctatatacagcagggatgcatcaatgaataaaatagacagaagttttggctctcctggagcttatattttattgaaaaaacagagtgaacaaaaaatgtgataagtaatatagtatgttagaagacagtaagtactatgggaaaagtagaccagggtaatggggatgggaaatgtggaggtggagctgtctgcagttggaattttaaatgtggggagggagtcatggtagttcttattgaataagtatgtgaagaaagtgggggaggaagtaatacagttatctaggagagcatgaaccaccttggcaaaattgtgacggtaagagaaatctgacatagctgactccattttgcttctaacctccaagctgtcctgttcattcctgggtgtaggccaagctgactttgggagaaatttagtttatagtttaaccttaaagcaaagatgataatagtccttccccaaacaaccccttccttggttgggggaccaaaactgcctttgtaaaactaacaaattagccgtaagattagaaattatgactcaggagttatgcaggcagaggtcaaaacattagtaacctccccacttgctcctatggatatcaactctatcataggacctaagattggtgttcaaggtatttttcagattctaaatcctgctggaccagctggtgccacctggactggtaaactggctcaactggttttgtgatcccatccaggaactgactcagcacaagaagatatcttcaactccctgtgatgtcatccccaacccaaccaaccagcatttgtcaatcactagccccctgcccaccaaattatccataaaaacccaaatttttgggtctccaaatttttgagtgctgtgggtgggggtctggattcttgattttgggctttgagtctattcctgatgacttttggcttggtaaaaagtcttgatttagagccagctcttttacatggtttaataaaataatccacgcattattattaatgcaaagattaattattaattaataatacatattattaatgcatagattattattagtgtacttctctgtatggaaaagaagtctgatctctttagggtactgttttaactcaaccgtgggtccttcttactggaaagatttctttctttagtacaccataatttattcattgttttcataagcatcattgcagaggaaacagagatttttgttttttaggaaagctgatccaaaatttagagattatgagtttattggaggtctatgattaaaataggattaccatacaaaatattttttaaggcaaaacaatctttcattttatttgtttgcacaggtgacaccattatccacatggaaccacaaggatttatgaaaattctggcatgtcttgccagttgttccaactgaaaactatcctatgcgtggaaatttgcttctacctcagagtctaaaatttaagctaagaatcttgagtatgctgtggtaaaatagaaagaataactacatttaagtaaatatcgagcaactatttgctttccttattttcctcccaactcttctggttttaataagattttctagttatttaaattgaactatttagttgatttaagttgaaccaacccaagaaacaggaaactagttaagtcaccacttgagcaaaagagaaagacgagaattaagttaggttgacaagtgtgagaagaaaaaagagaaaaagttttgttgatctttttaacctcttaaatatctcatatttgtctattttccaccgtcaccaccacctggaggaatgcagtagcctcctaattgttatgtctgtatttactttagcttttgcatttctgatctatttaatacattagcctgccaagatattttaaaaaatgtgaatttaatcctatcatctccctgcttaaaatactcttaagccttcctgttgtgtttatcaaaggccgaaatccttaccaaaacccctccatggtttgctccctacttcttctctagttaatttttactgcaatgcccttttcattcttttatgctcccatcccataggtcagtttttatttccttgaaagtgccagatatcccttaccttggagtcttccaagataccattttccctgcctggaattttccctcattctttccgtgagatcccaattcaattgtcttttggaaaaaccttctttgacacttcacccagttttcaaatagataaaatttctttatgtaagttctcaaaacaccttcctattagctattattagatgagtttgtgttccatgaaagcaggaactatgtttatcgttttcttagcattctattactagaaaactatgacctatggctcatctagacaatggagtcactgtgtctaaaactaatactaagataaagatggtggaaggtcatgaatgttctttttctaaataaagacctgtttttgatctccacccttggacttttccagttttgttttcatagctcttcatattgccaggctgtactactttttgaggagacggtttccatgtcgaattagctcccctgtgaaatgggtttctttccctttattctaacctggtcttcctgaagttctatagggaggctgtgtctaaccatcatgaaatttgatgagcctgtactctgatgattttacaggtccatcctgtgcttctcatgattttacaggttcctgtcccagctggtctatctttttattacagatgtgagtgtcttgatgtagaaatctctcttctctgctgtatgcttcctacccagcaacttttatttttattaactggaatgtgtctcactatgttgctgttttctaaatctgttaggagataagacattctgcttcagttggatgttgtttatcatgtattgtattacaataaaaacgtatgaaactttattatagtatataatgttattctggactacatgcatctatcaataaataattgttaggcatattctgtgctccaggcatcttactacatgctgttaaaatacagctcctgccttgaagcccttactggtcacacatcagaaactcttcttgttcctaaaatgacaaatcaaacaaacaagaataaaacaaacctcttttttgtatttctgtcttcacattgctatgtatttgtttcaaagaatgaaaattggtttctatctgaaactagtaattattaacatttgtttagtactgactacatgtaaagtatggggttaaaatttttacaaaacattgttacttaactttcatagcaatatctgagaagatttctttatcatgatgatgaaactattactggcactatataaaatattcataataagagccactgacttagccagcacaaaagttagatttgaaccgtgtctaccagatgcccaacgccaatatttaagcactatttactgctactagcctagagatctctgttttctgatgatgcagcttggacatgtatcattcctgtattcatttgaggaaaagaaacaaagtggaagctcaatagtaagtaagccaattatttgcagctgcctgtacctcagcacacagaagccagtcaatcagtgaaagtgttctttgatattgagttatataattactgaagagtcctgcttaaacagatgttgctgtgtaggcgctccagccatagcctggattttagtagatcctggagatacctgcaacaatagatcatggagacacctgttatgtacttaataagcatattttccaaattagaaaatggaacatatgatgtgataattgtaagtaaacacaatagacatatgcaggacactatatacagataggtatttcccagcatgtatttgtatttttaacaaacaatgttttgttgctgctgcttggcatcaatataggcaactgggcagatgttggcagtgagggggagaagggtaagtttaccagattcttcttagttggttattagaaatgaatgcactagttagtgtaaacaactttgctttcttatcatgagctgaaaaattttcaccttaggaactgactagagaatgtacaacattcagaagcctgaaggtacgtaactattagttctcaggcagtcttcaaagcccatcataaatagcatttgtcatcaaatcctcccatacattataatgtgctgtagctgaatacagttactggttgaattattgatcttgctaaaaattaaactttacctatttgtatttccaagtgtcattgttactcaaataaggaagagttagtaaaaaaaagttttgacaaatggcactcaaacaatttggtatgcttacatatagaaaaataaaccattatccttatcttacattgtacaccaaaataaagtcaaaatgggtcatagatctaaaggtaaaggaaaagctgtagacctagaagaaaacattggagaagttattcacaacttttgggtaataaaaatttcataggtatgacaccaaaatcataaaccacaatgaggaaaaatcatgtcttggacttcatcaaaattaaaaacttctgctctttcattaataaaatgaaaagacaagctttagactgggagaaatattctcatgctcttgatgcccatatctgacaaaggacttgttttcagatatctaaagaagccctacaccttaataataaaaagaaaaaaagatataagtagtcaaaagatctgaataaacagttcacaaaagaagatatgtaaatggcaaatgagtacatgaaaagatgctcacatcactggttatcagatgaatgcaaatcaaaagcatgagatacactacatactcacccaaatggtgaaaattaaaaaaacctataattctaagtattggctgggatgtggggtaacgaactctcatacttctctgtgatggttgggggacacagcagtgtatttctctgcacttattgaagccactgagagagaaatgatgaagatgggtctaggagaggcatgtctaaccccaggactctgcttgaaatgcccagctgcttctggagccaacaggaaaatcactacacagacaagaagtggctaggggtgtggcaacacagatgtggaggttacagagaaaacattcattgtaagaaaaacacctcctgtctgagcccaaagagcgcatctaccagatgtatcatttaccagaaacatctttacctgtgaatcttgacttgaaggtgagtttaaaatcactatcaattaacaattaaggttaacaattacaacaattggctgtgtcttaattaaactaaactggctaatgaattggctaatgagactcagaaatacgtgtctgaaaataagtaaaatagctgtgaattgttggatgttcaaattcactcattcaacaaatattttgagtgtctaccatgttccagaaattgttctaaatattaatgcatctctttgtttcttaaaaataaatactgtttcacaaataatttggttataggccagtgtgttaagtcacagggctttcccccatggagacctaaatgtctgcatttgtgtcagaacaatactttccaaatgatctagttccctggagtgtgcagatgacttgtgttaatggcttgtgatggtgaccccatctatcagaggtgtttgaaccagagcaactccatcttgaatgggggctgggtaaaatgaggctgagacttactgggctgcattctcagacagttaggcattctaagtcacaggaggtcagcacaagatacaggtcataaagaccttgctgataaaacagtttgaaataaagaagctggccaaaacccaccaaaaccaagatagctaagagagtgacctctggtcatcctcactgctgtgctcccaccgaaccatgacaggttagaaatgccatgacaacatcaggaagttaccctatacggtctaaaaaggggaggcatgaataatccactccttgtttagcatatactcaagaaataaccataaaaatgggccaccagcagtcctcagggctgctctgtctatggagtagccgttcttttatttctttactttcttgataaacttgctttcactttattctatggactcaccctgaattctttcttgtgcaagatccaagaaccctctcttaggggtctggatcgggacccctttctggtagcacatctgcactaaaatccgagtgtgcatcaggttagaatgaggattggaatatgtgggctatgttgtatgcagagtttaaattttactaaagactctcaaactgtgttgttttttttttttttttgcgactgagtctcgctgtgtcgcccaggctggagtgcatgtgcagtggggcgatctcggctcactgcaaactccgcctcccaggttcacgccattctccagcctcaggctccctagtagctgggactacaggggccacaacgcccggctattttattttttattttttagtagagatggggtttcaccgtgttagccaggatggtctcgatttcctgacctcgtgatccacccacctcggcctcccaaagtgctgggatttcaggcgtgacccaccgcccctggcctccaaactggtttttgaagtgttataactttgtgatttgactctcgagagtggtttctgagagtccgtttcaccacttccttgacagccttggtattgtcaaacttaaattttgttcgtcaacctgataagtgtaaatgctttaatttgcatttgattactagtgaagggtatcatctttttatatacttattagtcaaatgagttccttcttttctgaattcgctgctcttctatggagctttcactattctctacatgatttatgggcatttattataggttcttgaaaataatctagtgtaacctgtcttgataaatgtcttccatatatggcttgcttcttcgttttacctatggttattttgtatgcagatagttaaaattttaatgtagtcaaattactagtcttttcttttatagtttagtgtttagtatcaaagataacaatctttcttactatgaggccttaatacagtgttttccaatgttttcttctaattattttaaatttaatttttctcatttgggtatagtaatgttgtttttgaacaaagcttgaggaaaagttatattttatctctccccacaccaataaataatactaggtattcaacagtttaatctttctcccatattggttcttccgtctgtttcccagctaattatcttccactactgaaacaagatcttcctgagaactctacctaataatccgtgaattaggagtttttccagtttgactgctgggaacaggcaggattcttgttcccaagggagcaccaagtgggcagtgctccttgtaatcctcttggatgtttttttccgctggcctcaggtagttgtctcccatgcatgtgctggccagtattctgctgggtactcaagggagaccctacgcagatctctgcagttttttctcggtgcatctcttttccattgggtgccctatgatgtgaattctatctgccttgatctcccagatctgaactctgtttcaactcacagaactgaaaaagaagttaacccgagccccttccccatttattatgaaagacaggaatttttcatagaaacatttcaaagcgaatgttaaattagcattttaaaagttatattttaggcaaatttccagataaacaaactggttaagacacaattttttcacttctaattttgcatcaaaattaggttctcttttcaaaaaaattattttattttattaatttttttgagacagactctcactctgtcacccaggctcgagtgcagtggcaggatttttgctcactgcaacctccacctcctgggttctggtgattcttgtgcctcagcttcccaagtggctgggattacatgcatgtgccaccacgcccagctgatttttgtatttttagtagagatgggtttcatcatgttgcccaggctggtcttgaactcctggcctcaagtgatccgcctgccttgccctcccaaactgctggaattagaggtgtgagctactgcatctgaataaaagtagattctctagtcttcccaggacgtaatggatctgattggccctgtccaatcagtgctgctggtttccttccagtctgctcttagctttgtatttacgttctccattattttctggagaaagactatccaaaagccatatctaaagaactgccttttggggagatttgtaaaagctacagtgttgctaatctaaatcaaatgtaactattttataattacacataaagtagattaaatgaattataggcaaaaggaaaattatttgattcttagtggataaatggtatgcaaaaggatttatattcttagtacacggtactattcacagatctgtactgttactataaacacagctacacatgcttatctttctgctatttagaagaaattaaagaggaaagctggaagcatcaaatctgcatgatgtttttgggggatggagtagggaggttgtggctatcatgggtgcaaagttgagttggcaagagtcaaaggggacttctagttttaattttaattgatgttttttcaaagcatgccattgatgtcattcacataatattatttaaaatgatgtggataggctgggtgtggtgagcccatgcctgtaatcccagaattttgggaggccgaagtgggcagatcacttgaggccaggagttcaagaccagcctgggcaacatagtgaaactccgtcaaccctgtctctactaaaaatacaaaaattagccaggagtactggcacacgcctataattccaggttcttgggaggctgaggcacaacaattgcttaaaccctggaggtggagattgctgtgagctgagattgcacccctggactccagcctggtggagtgacacagtgagactctgtctccaaaaaaaaaaaaaaaaaaaaaaagatctggataaaatcaaatggattttgattttgtcaatagtggtatgatctgggttactctctataatataatttgttatagttaaaaaaaatttgtgcttgaaatcaagatacggttgaggctggggatatgaagccacttatcttttgattaattcgaagtttacagctctatgatacaatcatatgctgttgcctaaaaatataatactgacatcttaaatgtaagttttcctccaagatatttctttctcacactgcattcttgactgagtgactaaggtttgtcatcacattctcttacctctctctaaggattctgccatatttgctcccagcacccatgtatctgatcctgatggcagtggtggcctgtctggagcagctgttgcggggatgcccgctgcagtgggggaggtgcggccagggctttgcactctacagagctgaagggagccgggaacaggcaggaattccctgcctcctaccgagttggtagacggggagcgctgtgctcctgggtgcaactgcagctgcccagctgtggctccagacccaggaatccttgtgcttttgggggcctgggaagcctccctgcccccacaggctcagaagtgcctgctcccattccctggcctctcctcactcctggcacccactccgagtttggagcaaagttgtggccgagtctgggtgctgtcgcaacccggccggttgtacacgtgcttggagaagtactgtcacaccagccccttactgctgccttggccccctctggactttgggtactgttgaacatgggaaggaggcttggagtaggggccaagggaagcttggtgtgggcctacaggcacacctctgcgatggcctgaagcctgggggctgggctgccagttctgggtggagtccaccgcccagagtgggaacttaccgtgctttttctgggtccacacatggaccaatcagcacacacttttgaacccataaaaataggtttcgaacccataaaatgtcttttgaaaaatgtcttttgaacccataaaaaatgtcttttgaacccataaaaatcttgaactcggccagattcacacagatgtcgggactatcaactgcagaaaggagctacccactttgggtctccctgacttgtcaggacaacctgcctgtggaaaggagctacccatttcaggtctcctgagcgctgttctgtcactcaatgaagctcctctctgccttactcaccctccatttgtccacgtatctcattcttcctggacgtgggataagacctcgggacctgctgaatgatgggactgaaagaactgtaacgcaaacagggctgaacaccaccccaaccccaacatcgcaccccctatgctcaccacgttgtgggaaatgaggagagagctgtggccctttaaggagcccagacctgggagctccctgagccagggctgtgacacccagtttggggctctgcagttccaggcatctccaagcttctgggtgccactgcattccctggtgcccattgtggaagctgcttgtggtatgcctggtccagcttcagcctggcagggagccagggcctgtgctggcacctggagctgcccaccccaccacagccggcatacctggctgtgcgcaatggccggacccttcactaactcacatacccctttccactccgtgcctggcttacccttggcagctgtggtatctgggccagtagcatgagctgaatgtagcctgctgggctgagtaggtggaacgagcccagtgggcccaagcaaaacttgggcaaagatgccactggacacagaggtttcgagctggaaaagtgacaccctaagtgtcctgtgacaatcctacagaaaagttgtattgctttctagagtacatttccaaatacgtattcctaacattcactttgatatggctacgggaggccttgcattgtgtgttattttctttttcttttttttttttttttaagatggagtttcgctctgtcatccaggatggagtgcagtggcacgatctcagcttactgcaaccttcgcctcccgggttcaagcaattctcctgcctcagcctcctgagtagctgggactacaggtgcatgctgccatacccagctaagtgttgtatttttagtagagacggggtttcgctatgttggcctggcttgtcttgaacttctgacctcatgatccacctgcctcggcctcccaaagtgctgggattacaggcgtgagccaccacgtctggccactgtgtgttatttggaacctccgtgtacctatgttagctttccttggctttatcagttgagattgttgcattttgaagagaacatatatccagttcttctgttttgcccatctgctccataatcactggtgatagttttgctctgagatagatcaggcctcaatgaacagattagtaaaagaaaaacacaggagaaagtcatgatgatcacattatagaggcttataaaataagaacaattcctccaatttagaagttggaggaatttttgcacgtggtgttagcagatgtgcacagcgttaacatttctttaataattttgcttatagccacaaggtgacaggggttctctttcatttgtaaactatgtctttcttatacctaggaagtatgtttacgttagaagagcatattgctgattggttgacagacagacaggctgtttcatttattagattaaaagaaacaaacaataaaagctttgtttggctacataattttatgcagcatttttggtatcaagacaaagtatcaggatggagaagatgcggagacctgtcctaattatattttgtctatgtcttggctgtaagttgagggttctaagaactggggaccccaggagacatttattcaagtccttttggggagatggggatgtagtctggacttacttgtcattgcttgtttgagattaagaaataaaattatgaaaggtctaaattaaaatgtacatattgtacctgatgtctttctgaataggggcaaatggagaaaaccaggtggagcacagccctcattttctgggaccccagcagggagacgttgcctccatgagctgcacgtactctgtcagtcgttttaacaatttgcagtggtacaggcaaaatacagggatgggtcccaaacacctattatccatgtattcagctggatatgagaagcagaaaggaagactaaatgctacattactgaagaatggaagcagcttgtacattacagccgtgcagcctgaagattcagccacctatttctgtgctgtagatgcacagtactccctaggcacctgcaacctgtatccaaacatgcagctgggtagaagtaccataacagaagcatcagcaataggggccctgagcctgagtagacgtgaagaactaaggcatgagtatgaccagagaggggaggagataaagggtgctgttcatttgactcatgtatcttttatcaggccacccttcacaaagaccgtctttgtgccttatttgaattgatcaatcctgacccttcctatcttcagcagaatcctttagtgcccaggtcagtcttctagcatagagagcacttgttctcttctcaggcctggtggaaacacatgtcaaagaaatttgaagactgttgtttttctactgtaaaatctgacaaaggaactacaatggttggaatcatatgtgaaaaatgctgtagcagtggttttcatttactcacccactgaacaagtatctctcagctcctgatatgtgccaggtactctttagtcattgggatgcattggtattgaacatagcagataagccatcatagagctcatgtttcctaagtttctgggatacacaaaggggaaaccaagtctgcctaggatttagaggttcccgagaaattgcagcaagagtttagtttcatcttcatcaatcatttttctcatggaaacatggttaaagattggggacagctgaatgctgcttgaatctgtgggtcaagaattggcttcacatgttgaggtattgtctgccagagttgaggagaaatgccaggtggttttcggtatcatctggccatttccaaacaagtctggaaagtgaagtgctacaggctgtcataaataaaacaaatctataaagcctgaccctttatttaatggaattgtggagttcaaataaaatatcaaatacgatgctattgatgaatagcactaaacattggacattattttaaataatttgtagagtagctttctgttactgtagattctagatgctcttttggggacccagctcaggacaggctaagtggaatttgtgaaaccatcagaaaggagaaaggagaagctcagtccactgagccaatgctgtaggagttctttatatccagaatacataacgaatggctccaactttatagtgccaattaaaaatatgtaaaagacttgaacaggcattttacaaggaagataaaggaatagccaataaacacatggaaatttgttctatgtcttaagtcataaaagaaatgtaaattaaaaccacgatgaaatattactttatacctatgtctaaaattaaaaagactgacaacatcaaaccctaggtttccagtggccttgctgtcctgaacaggtgcaaacagcccagagctggggaagtctacaggccctgaatatccaggaggaatagccattgccataaattgaaatgaatatgattctgggatcttgttaaaagtatacattaacttagggtaaaatatatgaattaacttagataaaatgacggcagtattatggcaagtcttcctatccaaaagtgtggtaggtttttaattcttttgtgatctccaggagagttgcaatatatccagaatatagaaagaacgactacaactttatagtaacgataaaaaacatgcaaaagacttgaatacgcattttacaaggaagacaaaggaacagtcaataaacaaatggaagtttgttctatgtcttaagtcataaaagaaatgtggccacgcacggtggctcatgcctgtaatcccagcactttgggaggccaaggcgggcagatcatgtggtcaagagattgagaccatcctggccaacatggtgaaaccctgtctctactgaaaatacaacaatcagttaggtgtggtggcgcacacctgtagtcccagctactcaggaggctaaggcaggagaatcacttgaacctgggaggcggaggttgcagtgagccgagattgcgccactgcactccagcctggtgatagagtgagactccatctcaaaaaaaaaaaaaaagtaaattaaatgagatatcacttcatactcatggctaaaattaaaaagactgacaacaccaaattttggtgagaatgtagagtccctagaacatgccttactcatataggtttaaatggatacagccacattggaaaatactcaccctatgatccagcaagtatcttttgaggcatttacccaagggaaatgtaaaaaaaaaaaaaatccactttcctgtacaggaatatttatagaagctttattcataatagttccaagttggaaacaactcgaatgttcatcaataagaaaatggagcaccaaattgtaatttattcatactcagcagtaaaaaatagactactgacatataccacattgtaaacgaatttaaaaattttagttgattgaaataagacaaacatggaacaataaaaagtgtatggttctttaaatataaagttcaagaacatgtaaaactaatatatgtgaatagaaattttaaaaagtgcttgtctgtgcagggtggagatccagtagaaggtggtgtagcattttctggggggtaatgaaagtgttctattactctattggggtgttgatttcaagagtatatacatttgtcaaaacttcagtgtacatttgagatcagtgcatttccctgtgtgtaaactctacctcaataaaaattatttaactaaaaaaccttattttgcaaggatttaaaacaatcaataaattgtatccttacattagcaatgaataagtaaaaaattagcaatgagaggcacacactcattcaataactgttttggatagacagcaaagtcactgacagtggcttttctttttgattcctgggatccttcagagactccatctctttgatgctgcagaaaactggggtcactggtggcaggtttcttgtggtaggtagatttcccatgagcacctgttttgatctgtgtttccctgcccttccaatggttgagaagcttctgatgctgtatgttaaatgccaagagagaattcagtttccctgactttaccctatttaatctaaatccttggattacaattgttgggtgctagaaatcagatgttcctaataaagcccactgttacttgggaaaataagcaatttgtgtccttgatcatatggttctgacatatttcactcaaacctactggtataattcctaagatatattctctacataaactcatagagaagaacaggatttcccccacagaaagagacagtgtggacatcaaaggaaactatgttaactcaaaaaggtgaagccattatgaaaatagagtctcttcaccttataggtgtgctgttcatataagctaaacggattacagacaaaggtccaaggaacaggggaagagggacacactggttctgaccttcatgaagataaggcacaaaggaggagggagaaggaaaagagtctcgatgcttcgacctaaacaaatccaggagagtggattctgcaggaaatatactactttcttgtctaaggataaaactttacatggcttttcagagcaatgatctctctctctctctcttcagcatttaccattttttaaaaattttattttattattatgatactttaagttttagggtacatgtgcacattgtgcaggtttgttatgtatgtatacatgtgccatgttggtgtgctgcacccattaactcgtcatttagcattaggtatatctcctaatgctatccctccctcctccccccactccacaacagtccctggagtgtgatgttccccttcctgtgtccatgtgttctcattgttcaattcccacctatgagtgagaacatgcagtgtttggttttttgcccttgcgatagtttgctgagaatgatggtttccagtttcatccatgtccctacaaaggatatgaacttatcattttttatggctgcatagtattccatttttttcataagcacaaaaggcaagaagaaggaactaaatagtgtttatttattttaccatgagctgagagtttagcagcttgggagcatttttccacaatgccagaaccttgtctttgaatctttgatgctcctctagctcactgttccaaaatggcattttaaaaaccattgctgatactgcctaaagcaatttacagattcaatgctactcctctcaatctaccaaagacattcctcagagaattagaaaaaacaattttaaaactcatacggtgctgggcatggtggcttatgcctgtaatcccagcactttgggaggctgaggctggcagatcacctgaggtcaggagttcgagaccagcctggccaacatggtgaaaccccattgctactaaaattacaaaaattagccaggtgtgccagtggggtcctgtaatcccagctactcgggaggctgaggcaggagaatcgcttgaacccaggaggcggaggttgcagtgagccgaggtcatgccattgcactcctgcctgggtgacaaagtgaaactccattaaaaaaaaaaaactcatatggaaccaaaaatagagcccaaatagccaaggcagtcctaagccccaaaataatgccacatatctacaatcatctgatctttgacaaaatcgacaaaaataagcaatggggaaagtactgcctgttcaataaatggtgttgggataactgattagccatatgaagaagattgaaactagaccccttccttatgccatgcacaaaaatcaactcaagatggattaaagacttaaatgcaaaatttaaaactataaaaactctgaaagataacctagaaaataccattctggacataggacctggcaaatatttcatcacaaagacaccaaaagcatttgcaacaaaaacaaaaaattgacaaaatggatctaattaaactaaagagcctcttcacagcaaaagaaactatcaacagaataaacagacaacttacaaaatggaataaaatttttgcaaactaggcatccaacaaatgtctaatatccagaacctataaggaacttaaacaaatttataagcaaaaaacaagaaaccccattaaaaggtgggcaaagggtacaaacagacacttctcaaaagaagacatacatacaagtggccaacaaggatatgaaaaaatgttcaacatcactaatcattagagaaatgcaaatcaaaaccacagtgagatgccatctcacaccagtcagaatggcaactatgaaaaagtaaaaaaatgacagatgctggtgaggttgtggagaaaagattatgccctgctggtgggaatgtatattggttcagccatcgtgaaaagtgatgtgatgattcctcaaagaacttaaaacagaattaccatttgagtcagcaattttgttattgggtatatgcccaaaggaatataaattgttctatcataaaaacacatgcatgaatatgttaattgcattactattcataatagcaaagacatggaatcaacctaaatgtccatcaatgatagactggataaagaaaatgtggtacatatccactatggaatactatgtagccataaaaaagaatgagatcgtgtcttttgcagcaatgtgggtggagctggaggccattatcctaagcaaactaaggcaggaacagaaaaaataaataccacatgctctcacttacaagttggagctaaacaacaagaaaacacagacaaataagaggtggacaacagacactaggaattacttgaggctggatggtgggagaagggagaggatcaaaaaactatcttttgggtactatgcctatgatatggtttggctgtgtccccaaccaaatctcatcttgattttagctcccataattcccactgtgtcatgggaggaacttggtgggaggtaattgactaatgaaaagtgtgggtttttcctgtgctattcttgtaacagtgatacgaacaggaggcagggaaatactgggtagaagaaggtgcttccctggtaaaggccccaccctctagactggaaaccgtggccctaaatgagaacagttatctcagttttttcaccgaaatgttgccttttgggcccaacctgcccccctatcctgtgccccatataaacctcagacgtcagctggcaaagggacaagcagctgaacattgagaggagaagaagcaactgagtgtcggagactatggatagacatggcttaacttcagacggcatgacttcagaggggagcctggccagagatggctgggcttcagggaaaaagatcaccttcttcccacacccatctcctttccagctccccttccactgagcgccacttccattgcttaataaaatcctccacattcatcacctttcaaaccattagagtgacctgattcttcctcgacgccggacgagaattcgagatgcactaggtgcaggaacccaaaaaggctgtcactctgactcttcactgagatgtttaacacttaagctgtccgaagatggcaaagctaaaagagcattaactgtaacaaacccctaaatgctgccgtggggccagagcccaaaagcactcacctcagccctggcacccacttgcctacgtgctcatttctgtgaggggttcagcacagcaggtttgagcaagcgaagttcatccctgcaggcgctgaagtggctggctggacccagagctggtgcactccagttcctgcccaccaaagggtcaagggaactatcccatctcagtagcgaataagtctcacgagatctgatggcttcataaaggagaattcccctgcacagactcttttgcctgccaccacgtaagatgggactttgctcctcctttgccttctgccatggttgtgagggctccctagtcacgtggtactgtgagttcattaaacctctttttctttataaatcactcagtcttgagtatgtctttattagcagcacgaaaacggactaatatagctcatcaccttggtgacgaaacaatctgcacaccaaattctgagacatgcagtttacctatatagcaaatctgcacatatacccctgaaactcaaataaaagttttaaaaagtcatgactacaacataaatcacctgagggaactttttaaaaacacagcttccccaggacagtctcatagaggttatgtcagtatgaataaggtggatcacagaatctgcatttttactatgctcccttgctgattgtgatgcaaagctaggttcaagaacccatgctgtaagatgcttctgaacatcagctaccatgtctccatgtggtagaagagtgtttgaacttgctttccagtctttggaagcaaatcaacatcacccatatgtttaatcccctatgtgaaaataatttatgtatgtacatgtttttatatgccatctatactaaatgctatctaccaatcatctatttatctaccaatcatctatctatctattatctatctatctatcacctatctatctatctgtctgtctgtctatctatctatctatctatctatctatctatctatctatctatcacctatctatccatcctattggttctgtttctctggagaaccctgactaatacagacagtgtcctgggaataaaataagcctctgaataaatagcaacaggtgttcttcagatttgaaaatggtcacctggcagctgaatgtgacttgaaaatgaggtccaaggtaagcatgtggcactatctttcaggagaaaacgttccttgcagtgtagtcccttgcctgtgagggggcacagcttctgaaaacaaatacatctcctgctaaaatcttaggttcatgttcagcattttattgagatgacaatattttttatgctatgcagttaagaattgaggatgccagaggttttaaagatggaattttcaccaggtccagcgattacaacactcgtaatgtttggtaagtttggggaaaataatatgcctgttaaaatttggatttttaaaatttgttatgtcagtataataaccacaattttgtccaattcaaactcagggtgatatgcagctttttatttctgaggaggaagcagtagagactcagggacctggatagaaagttagtggccttctcagaaggagctctccctattgtaaactcttcctatgccaccatggtgaacctacccttttctggttatgttcaatatcctggtgaaagtctgcagctcctcttgagaactgcaaaggaaaatgagaatggaagcaacaaagactttgaagtcacatatcacgaagaaaaaaaaaacacctttcagtgggagaaactttgagcttaagtgtcagatgtggctgcttcatgctgtgctgtgagccaaacacaccgagtggggctgcaggcgagctgagacaaggttcagtggcccaggcaggaccttgctgctgaggagctgctgcatgactcttgctggtttaaggaaaacgtactgtggtttgaccttcagacactctagcagatgtaaagatcacctacatcgactctaaggacacagcagaagaacgggaagtgaatatggcctgagcataactctccttgtagaaagaagaaacagggtctgacatccttttccagagatcagtgaagtaagctctgtcttcttcttactaagttcagccctgtggctttgaccaagggcacctaaagaaatagtgatgtatagtatattgttttctctttagagatgcaacatgaaatatgtaaggttgcatctgcataatgtctccctggaagagggagggttatttcctagagcacataaggaagaaccccaacgcaactagttgttaaaaaaggagaaaatagaagggaagaaggaggaaaaagagagtaccacatgtaaacaaagaatggactgagagtgacatttgtcatagtttgttttgttacaaatcaaatagcagacatgaaatggtgccctcagaaaagtgaaaacaagcacataatttgtttgtggctcaagaagacatgaagaagtggctcacgtccaaatcctacacacattcctttcccccttctctccttctcactatatattggttagctggcttagtaaagcaaatcctaaattgagacagatgggtggtgccgtagagcctgatgaaggagaacactcaagctcaaattcttcatggcagtatagctcaggaatggtggatgggggaaatgctatagcttcctcaactccttgtgagcctttccttctcctcaaggagaaagaagtttaaggtagccatgtgggtaggggaagaaaatggaggagaaagagtacgactctctgaattgcattgcagatatacctgaggtctctgtaaatattggagtaacttttcttgtctagtacaggcatttaatgaatattcattttgatccataaaaatgaattttattttcaaggagaatggtgcttgttaagacaggaggatgatagagccattcatggtgtctcaatagctcagggactgaagtgaagcaactgtaaaagtccctaaaaatgttattatcagcgaagggtccttatcctcaatcttccccttttctctgtttcccttcctaagttttttctaacattttcttttatcactgaccctctctctgagtcttatgaatgagctgaagtaataacccctctctaattttattttctaccttttttttttttttaccagttctgccttcttagtttacatttttaaaattctcttttaataaaatattacatgtgcatgggtaaatgcaaaacttgaaagagagaaaaactgtacaattttaaaaagttccagatttttggttgaacatggttgattaaatattcatgtttattctctgctccctcctgaggccctagtgaaatgctaataaagaagttcaaagcctgtatgaacatacaaacacaaagtgaactgaaaagatggtgacagcacaagagagatcaacataacgttgaaggcgttgaaagcaaatggagaggtgacaaactggtttaaccaagagagaaaacctgtgcctgtagaggggaaagctgagagacagcagtcctgtgcattctgcagcattctggaaatgctcaagaattagaagcatcaattttgatggggaaaaaggcatcaggtgtggagggtagatgggaaagaaataggaagattaatggaaagactagcctcaagaaggagcagttggaacccagtgtaaccctcctatgtcctttgccacactgtaccacaggctgcaagctacctcaaatctggtggaagattaaaggttgaatctgattattttgaactagacagtctctggattagagaatactagagatatctgaggatgaaatgaggtgccataggcaaaacagggggattaagtgaaattctatatttctagtgttaagtccatcagctcctgtgcccaattcagtttaaaattctagttttccaaataatttttcatcagaatctaatatttgttgatgctgatgagaaatctaattccagtgggttaccccaattggagatttttttacttttatctccatacacatctggaattttttcccaacttatccttggtgttctagttttgctagaatacgtttaagtgtaagtctttttaattcagtgataatcacactttgcgggctattttcatctgaatatgcaatgtccttcagttgtgggaaaatttgttctatcacttctttagtaaatctctctcttctggttcttttttctaggacaaatattatttgcttgttttatctccaagattgattttctatgtagtagtatatttcagtgcatttttgactctttttcttctgtgtcctgagagattttctcaattttgtttttcagaccatctgctgatttttataaagttttggcaacaatagtttagtttttaaagagctctttgtggttgttgaatttttgttgttgattcttttaggttacatgtaactagatatttttgaacgttctcttttattcttagaattttgtttccctttgcatcagggtttctgattcttttcttgatatttatattttttgctttatactgaggcctagtcctccctgctgtcccttcatattataagaaggaaggactatacagctacaggtatttcctgtgtcattgtttatgtaggtctgttttccaataggtttccttgaagatgtgatttagctaaggaccttgagataggaaaattagcctggatcatccaggtggactcagtctaatcacatgggtttttaaaattggagaaacattccctgctgtggtcagagggagacgtgactatggttgaatgatcaaagagatgaaacattgctggctttgaagatggagggaggggttgcagaccaagaaatatgtgcagcctctagaagttggaaaacagactcactcctagaggcttcagaaagttataatgctgataacttgattttaactcaaaagagactcatgttgaacttctaacccacagagctgtaaaaataactttgtcttgttaagacatcaagtttgtgataacttgttatagcaaccgtatgtcaatttgcagctttttatttagaatatgtgaacaagggtttgatgctgctttcaacctcctcactcttgaacccctcaaactcctccccactctccaccagtgcaccaatgccagattgaagggttactcattacaatttatattgtagtctctcatatttgtgttttttccccatgacttccacttctgtagttaagtcatcatctcctttacatttttattcttttatcagtgggaattttggaaagataggcagtgagcaggtatggtcatctgatatctggaattagaagcattattcatggacttcttataagtgagagacaatctacaggcaaaaagaagcaaggcaatgagaatcccaaggacagatttgatttcctgttgctagaaacaatcacagtcccagaaaagatgctttctaactttagaaaaaggtccctattgccctgaggaaaggcagcgtgtttctctcttctcattttccctaaaattgatctcctggtgtgacagttactcgtttagccccagggtctacaggctgaagtgggagggaagaaaaggcctctttcagaagaacaggcttctttcagaaggacagccttgctattgccacaatcaacactatcttgttttacaagacttgactcatttatgtaaaactactggttgcctatctatgtcagatttcatgatcaaacagctcacatatctttttttcttttagatgtttttcttagctctggtctgctggtggtactccttcttggattccagggtaaatgcaaatgtatttttactctgtccctagttccttcagaaattatttatattttactttgcaatgccttcatcaatcctctcagttttttctgtagatactaaagtctatcaatgatgtcttgatgatgtagtacccagaattgggtgtaatactctggttatgttcccagcaaatagcaatgttattttactctcttatctgaatatcatattataatttttgttgatctaaagccactgtatctttgtaattctgcttgaagaagacaaagataatcctactttcttttcctagatgagggctcatgttctaggtgtcaggcctctgagcctaagctaagccatcataacccctgtgacctgcacgtatacatccagatggcctggagcaactgaagcaccacaaaagaagtgaaatagtcagttcctgccttaactgatgacattccactatagtgatttgttcctgccccaccctaactgatcaattgaacttgtgacattccttctcctggacaatgagtctcaggagttccccaccagaacaccttgtgacccccgcccctgcccgcaagagaaaaccccctttaactgtaattttccactacctacccaaatcctataaaactgccccaccccatctccctttgctgactcctttttaggacttagtctgcctgcacccaggtgattaaaaagctttattgctcacacaaaacctgtttggtggtctcttcacagatgcgcataacactagacttttattttgtacatctgatcttatttttaattttaccaaagtaggtatctccacatcctaccgcaacctcctctcaacctgatgctcactgcaacaagaccatttaaagctcagtcagaagagttgatctaactatttttgcttaaaggatgtctccacagcttttatacaaagatactgagggactccaaaatctgctagattcattgtgagatctttttctctgtaaattcctcctctcttttacagtcctcatttttcattgaggctaggattaatgtaatatactacagagggcaacacagtacagattagggaagaaagaaatgttcactggaagtttttgacatgtctccaaacaaggaaagcacaggttcacttcttgtggggagtctgtatcctcagtcctgaatctggcctccagagggtgacgttgcacaagggacagatggctgtttccaatgatgatcaacaaacactttctgctcagccccttcttcctgcagctggcttactgaagcaccgtcactggagttctttgaagatgggacaaatggagagaatcaaagattgaaaagcacttaagattatctcagcagattttgtattcttaccaaaacaagagacttgcctagcccaaccttcctcacgctcgctattctcaagacctgggttccagccactttcctactggccccgaggagaatttccaaagagacgcctgcagtgtttccacagctcagccatgctcctgttgctcataccagtgctggggatgatttttgccctgagtgagtaacattctattatggtctctagttccacagaagtaactgttttctgattcaaatcttagtagaaatacttttcatagacaagtctgcactattttcactgatacaacattgattttttcaggagatgccagagcccagtctgtgagccagcataaccaccacgtaattctctctgaagcagcctcactggagttgggatgcaactattcctatggtggaactgttaatctcttctggtatgtccagtaccctggtcaacaccttcagcttctcctcaagtacttttcaggggatccactggttaaaggcatcaagggctttgaggctgaatttataaagagtaaattctcctttaatctgaggaaaccctctgtgcagtggagtgacacagctgagtacttctgtgccgtgaatgccacagtgtctgggactgcaaagggagctgaacacaaacttcctaaggtgctagggagaataactgcctctgaaagattttggattctgtcacagtagaaaccatgatgttagtatttttaaaaaaatttatttttaatttttatggatacatagtaggtgaatatgtttatggagtacatgagatattttgatacaggcattcaatgcataacaatgacatcacgtaaaatggggtatccatcccctgaaacatttatcctttgtgttacaaacaacccaattatacacttttagttatttaaaaatgtacaattaaattattattgactgtagctaccctgttgtgctatcaaatactaggtcttatttattctttctatttttttgtacctgttaaacatccctcctctccccgaccctcccactatcgttcccagcctctggaaaccatccttatcttctactctctatcactatgagttcgattgttttgatttttaaatcccacagataagtgagaacatgcaatgtttgtctttcttgcctggcttatttcacttagtgtaatgatctccagttccatccatgctgttgctctaacccaaaagcatgtgagacgggtctcaatcaatttagaaagtttatttcccaaggttaacaacatatctgtgacacagcctcaggaggtcctgacaacatgtgcccaaggtagctggggaacaggttgcttatatacagtttagggaaacataatacatcaatcaatacatgtaagatttacagtggtttgatctggaatggcagtacaacttgaaggggagcttccagatcataggtagattaaaaaattttctgattggcaattgtttatcaatagaaagcaatatctggggtataataaggggttgtggaggccaaagttttatcatacagatgaagcctccacatagcaggcttcagagagaatagattgtaaatgtttttatcagactgaaaatatgtgttgatgttaatgccagtcagcccttaaattccaaaagggaaatccaaaagggaggggggtataaatgaggcatgtccaatcaccccttcccattgtggcccgaactattttttcaggttaacttcggaatgcccttggctgagagaaggggtccattcagatggttggaggcctgagaattttgtttttggtttatattacaaatgacaggatctcattcttttttgaagccatgatgttcttattccacagtacagagatgctcagggacttgccaggtgagtgtgaagttgctatattttaaatggttgagtatggaaattgtgacatggcacagagttttgcttttcattcaccattttatctttcaatatccagaacaaaaggtgaacttccttttgtaagcatatcttcttgcatacttactgttctttcaacttggtaattttaaagtagtttccctggagtcagcactctgtgctgattattttctctcctttttaagtgcttcatttaggaaggaggagatttattaggatgctggatggcttagaacaatggcatgctcatgtacagtctagtaaccttgtcaggaaaactgaagaaaggagagtgaataactcaaattccttagtagtttttacagaactattttttttttgagacagagttttgctctcgttgctgaggctggagtgcaatggtgcgatcgtggctcactgcaacctccgcctcccaggttcaagcgattctcctgcctcagcctcccaagtagctgcaattacagtcatgtgccaccttgcctggctatttttttgtatttttaatagagaaggggtttctccatgttggtcaggatggtctcaaattcctgacctcaggtgatccacccgccttggcttcccaaagtgttgggattacaggcataagccaccgcgcctggccgtaaagaactattaaggaggaacaaaatgctaggtctacttggaaagtcctatttattttttgtttttcccacttataaagaccaattcttattcttttgattcttaaattctgcaaatccacattataaatcttcaaaattgatgaaatagtaacttttgccaattcttccaaatgatgttattttagtttttactcttattccagtttcatatggttgtacagttggaatattagaaacgaattcttatctgtttaacactgccataattaagtgtgtgcaaaatttagcaatgtctggcccctgaagacattctaattaagtattgtaatgggaataaaaaggtcgaagggcatgtgatagatatatgacttctcctggttaggaagaaaaaaaatgtacaaacactttttaagcttcttacttgaagcctttaaggttaataatgacttgaagaaacgtaaagagaaagaggaggaggagggttgggcttttttgttgtgtacctcctgatgctgtcatgagtaagaggaataggaatttgaagatatagataataatagtggattgtttccagtgatttacctaagccaaaggggacaccagtagggatcagcattatttttcaggtcatagtgttatggctatttgtggtatatacctttgggggatttctggaaatgaagtaagatatataaaattattgataagaaatatatacttatttaaagtcttgttcttcagattatattctctactgtccccaagagactgatgatcttcataagacttaaaaacacagctaagtcctgtgttccagaatgactgcaagcaggtactttatacactacatatgagaaggacaaatggcaatttctttcaattccaaactgaagctcagtaccgaggaaatataactgctggcaccaagaacctcaagcacctggaaatgcattttctgctctcacaccaacaaccttgtttgagatgtcagagtagttctattgatatgattgttttataaatgtaaataactttatataatatagatattaaggagaaggtagaaatatttaacttctaacacaattatatttgccatatgaggagactgtaacattttaaacaatattatattatttctatctcttgatatcaataaatacataaatgtaaagtttcaaattttaaaaaataaataaaacattacagacaaaattgccatctcttttatttttttcctcagttttaatgccttcatccctctctcaaaataaacctattatgaacttttttctcaactccatgttttcatatttccaaacatagattttttaaacaatctgtggtgctgtgttttgtgtttttaaaatttacatgaatgtaatccaattgtatgtgtaattgtgaaacttgatttcttccctcaaatatttttcagatatagaaaaatttatatatgtagtatatttcatttcttttagctgatacatactattccattttatggatatactatatgtcccttttgatgcacattggattgtacatttacaaagctcaataggccacgtaagtattggtttccctcataccctgagtgttttcaagaggagtcctttcagctgtctatacagttcacagattactctttttgcaatgcctccctcccctcctcccacgtcaagtgctaaggtgcgagggaataagaccgaacaggccatccagacttagaaaccccataccccaaatagaaaccggtatctcctgtaacagttataaaagtcactgctccagaactatgacatcttaaaaagtattcacagtccattcacagttcagatgcagtttatcagtcaggatcatttttaccataaccatcttacttggtaatccagctgacgttctacctttattggatttccagaaaaatagagattagaaagttaatctaatttttttcatgtggaaggagaaaagattttgttaatcctttattcaatgagtgtttctgatcttttattataaaaattctacaaggaatacaattatgtttccttatacatagatatagaatgttttatgttatacacctggaagtggcatttgctgggttatatgattcacatctttaacaacgtacttgcaattgccgaattgctcttgaaatattcttacctatttttccctcattagtagcacagaagaattcctgtctctttacacccttgcaaacacttattatttcttatataacatcctgccctctctatctgtgtttcctgcatttctcaagtaaagtacgtatagtcattttttcaagatttgcttctggaagaacccaatataagagatctggtacagaagtggtcatagagaacaaatacatagaatgagattttggaattaaattattcatggccagaagggaacaaggatcccattattagcagtaggtgcagtggtaatagagatgctaaaagatcatagcatcacaattattaattgtggtgaattggcatgggattcatgtgtaagttgttgcagtagcttatgtgatatacttagcatttgagaagtattgtgataatggtaattttatgtgctatggagctggctatttattgtcaagtgccatcagggaagagcaataacaaaatggaaccagctaagaccactgcatatttcaacatctgtattcaatggtgatctttggaagacaatggctgctgcttcccatctgcctttcaaatcttgtgtaaatgctcttttgtattcagaaggggattctgggcactgtattttccagtgcagctacatcaacaatagaacaatccaacatagaaagccaagagccaagttcactggtgtgctacttagttcaccagtgtgctatgttgcacattgtcaactgggcttctttctcgtcccctttaatatattcccttgctttgctagggaagaaacccaaactacaattcacacaatccctttcattcacttagttttaattctacaaatgagaggcatttgggaataatatcaggcaagtagaaaagaaagagaaaccattattcttctgtagggactgtatgcaggcagctcagattaccagctgtgaggactttgtttgacttctgcgtttcttcctaagaatcactcattttggtgtcacaggcagctggatgatgcatcacacctcaaaatttcctgtaatcagtctttctcatctttgttcattagcccctccaatggttgtatgtctaattttgtgtattaaatcttactttttaaaagagttttaaaaataacttttactttagaaagttaatatgtgcattatagaaagctgagaaacacaataagcaaagaacaaagtcattcaccatcacaagcactttatagtttgatgtgtccttctgggtcctgtgtatgtatatagacaacatccaattttatgtgtgattgagatcatacagtatatatgatgttttttcacacatcatgaatatttaccagttcaaaatcccaaggctatatgagcattttgataacaaggaatataccacatcaactcaatctgttagaaaaaaagtaatcctgcctttcttggggacaaaaatttcaaagaagacaaaaatggaaacaggcctctaggttaaaagtaccgtcagagttacaattaaaataccacattccctttaatggtcaatttaaaaagagatgtaaagcaacagagtatactaagtataatgtttctaagagaattctttttctgatctgtactattaaatattagcaagaaggtatgttttcattgcattacttagtgtattcctatagtacagccaaaagagatgcacatacatcaatagctattatcaaaatgtaaatataaacatatctgcttacacctgtccctttatacttccttctgcccttcagctgccaatctactgaacacatcctgatacatacactgctcagaggtggtttaacaacaattccatgtccaaggtgcagcttttctatcaagcataaaaaatacatttacaaagtagctaatccaccagctctactttttctcatacgttgtcacctcagggcatctataaagcttagatgttgcaaaataaagactgaactttatccacaataaacacaggcaggttacagaaaatgcatatataaatctatggttaaatccaaaaaagtcacctaagtatggagatattagcaaagaggccttccctccatccttcctcttctttcaccattctagtgactaagtacctgattacatccagctccaaaagaaggattaacaaaggtcactgccagtagataggccttcttaaaaatgaacaaaaggacttttagaaaggcgttattttactacctctacctttaacatactttgggcattaggacttgtttatcttttaatacacagcaatattaacaaaaacacatacagggccgggtgcggtggctcacgcctgtaatcccagcactttgggaggccgaggcaggcggatcacaaggtcaggagattgagaccatcctggctaacacggtgaaaccccgtctccactaaaaatacaaaaattagcgaggcgtagtggtgggcgcctgtagtcccagctactcagagaggctgaggcaggagaatggcgtgaacccgggaggcggagattgcagtgagccgagatcgctccagtgcactccagcctgggcgatagagcaagactccgtctcaaaaaacaaaaaacaaacaaacaaacaaacaaaaaacaaaaaccacatacagaacaatggttagacgatctgaactaatctaacttacaggcacaaagcttctctctgcatacttccttttctccctatctcccagcatacaatgaacagtcagcaacctctctaagacatcaagtttaacagttccattccccaaatgcagctagtcctgtgaaatcacaaaaaatactcaaagagtgtcactttagctgtcttaatgtacatactttaacatatgttatgtacactttgaaatatctagaaagactagattttcatataagaacttaagttttccgttatacacagagtagcattgaattaactactaatgctataatgtgatagagttagtttactaactctatacctttgtcatacactggtaacctctttagcatctagaaagactagatataaattaggattaatttgtcctttatatacactatatacacagataaggaaaacaaaatgcacagacgtaagagacaatggctaatgttgcctcattgtaagcacattgccacagaactctttacacttccttctcctcccaggagccagcacacaaacataatgtgtattactcaagaggtggtttggccattcccctctccagcccccagtcaacatttcatatgaattttaagaaacagatatttaaaaaatttgttattttctacctctacttttgacagctatgaagcactttagaacatcaagaaaggcaagatagggcaggcgtggtggctcacgcctgtaatcccagcacaccactgcactccagtctaggtgacagagagagactccttctaaacaaacaaacaaacaactacaaaaaaaccaaaacaattagccgggcatggtggtgggtgcctgtaatcccagctgcttgggaagctcaggcaggagaatcgcttgaacccaggaggtggtggttgcagtgagctgaaatcattccattgcactctagcctgggctacaagagcgagactctgtctcaaaacaaaaacaaacaaacaacccccccaaaaaaaacacaccaaaaaacaaaaaaaactagatctatacagagcagaggcctcagaaataacgccacacatctacaaccatctgatctttgacaaacctgagaaaaacaagaaatggggaaaggattcctgatttaataaatggtgttgggaaaactggctggccacatgcagaaaactgaaactgaaccccttccttacaccttatacaaaaattaactcaagatggattaaagacttaaacataatacctaaaaccataaaaaccctagaagaagacctaggcaataccattcaggacataggcatggacaaagacttcacaattaaaacacaaaacgcaatggcaacaaaagccaaaattgacaaatgggatctaattaaactaaagagcttctgcatagcaaaagaaactatcaccagagtgaacaggcaacctacagaatgggagaaaacctttgcaatctacccatctgacaaagggctaatatccagaatctacaaagaacttaaacaaatttacaagaaaaaggcaaacaacctcatcaaaaagtgggcgaagggtatgaacaggcatatctcaaaagaagacatttatgcagccaacaaacatgaaaaaaaaagctaatcatcactggtcattagagaaatgcaaatcaaaaccacaatgagataccatctcacgcaaggtagaatggccatcattaaaaagtcaggaaacaacagatgctggagaggatgtggagaaataggaacgcttttacactgttggtgggagtgtaaattagttcaaccattgtggaagatggtgtggtgattcgatctagaaccaccaataccatttgatccagcaatcccattactgggtatatacccaaaggattagaaatcattctgctataaagacacatgcacacatatgtttattgcagcactgttcacaatagcaatgacttggaaccaacccaaatgcccatcaatgatagactggatgaagaaaatgtggcacatatacaccatggaataccatgcagccagaaaaaaggataagttcatgtcctttgcagggacatggatgaagctggaaaccatcattctcagcaaactaacacaggaatagaaatccaaacactgcatgttctcactcataagtgggagttgaacaatgagaacacatggacacagggaggggaatatcatacaccagggcctgtcgggggagggggagtgggggagggatagcattaggagaaatacctaatgtagatgacgggttgataggtgcagcaaaccaccatggcacatgtatacctatgtaacaaacctgtacattctgcacatgtatcccagaacttacagtaaaaaatacataaataaaaataaaaagaaagacaagatatttcaaaaaaattcttagcattgtcaacaatatatacagtagtgaggaataaaatgcgcacataaagcagtggttataatatgaaaatgtctcctaagcatgaccagtctggaaaagaaccttctcttcattctcactgccttctgctccatggcctctaacccactgaatgaacgtggtggtgtgttgctcctggagtcacttctacagctcgtctaacaactttcgtttcaaagagtcatttccagaaggcgtttgctttctaccattttttaaaagaacaaatgggcatttacaagacgtgattttcttttttctttattttattttatttttttgagatgggctttcactcttgttgctcaggctgaagtgcaatggcgccatctcggttcactgcaacctccgcctcccgggttcaagcgattctcctgggattacaagcatgtgccacctcgctcggctaattttgtatttttagtagagatggggtttccccatgttggtcaggctggtctcgaactctggacctcaggtgatctacccgcctctgcctcccaaagggctgggattacaggtgtgagccaccgcgctcggctgacgtgtgattttctaactattatacgtcagcaaccttttaaaatctagaatggctaggtagagcaaaaattttcttttaaaaggttgagggaaaagttgagagcagctttttcatattatttacctgggccttctataaaggccagtaaatcctcccaaatggtggggggcatttccagtccaccaaatgtggcatgtgatttctctctttgggtatcaaggtctggtagaacaaacggcaaccacgcaatggcctgctaaccactccacctgtccttgtgggggctctgctcaccttctaggcccttttaggcctttgtccatcatttctggcatttttgggaggaggtaaggtcttgtctaactgggacaaagtggtcagcccgggacccgcatctgtgcaactccatggcataatgaagttcctgagcttgtgtctctaggcccaccttcttgggttctgcaaactactgcagccctcagcgccttctggcggccgccattcttcttcctctgcgacatccatttcctcccaaaggcacggtgtcctccgcagctcggtgagggcttcgccaaggcgcagcaggatttctagatgttctaaagtgctttatagcccagcgaggtctgggcccagagaggctgccgccatcagctcactgaagtggggagagaaggaggtttgcagggccccagctcacctgcctctcagtgcgctgcttctcaccacattgtctgcctgaactctaaatgtctttctactgaaaatatttggattgttttatgaggagaccgaggaccacctcgtggccatcaagcagatcatccagaggcaaaactccttgtctgaggaattcagaagtaattattaatcgacgtccctattatcaaaagcaggcatctagtaccgggcttctttcccaaaaatgtataagtaactagaatttctatacatctctggaatgcatgtatgttgaaacttattgtgcagcccttgctgacatcaaagcaccaaaatgtctacaaatgtaatcatttatcctgacctaggtggctaatatggtccaaattacccttaagctcctgctttaaggttcataaatgctcctaaggaaaaatccacggtggcttgctcagtccgctcttgctgaagcgccctgctgcactcctctgcagcactggttctaataaagctttccttttcaaacccacactgttgtgggtaaattcttattaccatgagccaatcactttccgttgctgtggcgctgacacctcgcccagcatttctgtttgccggactgcctctcgactgacaacagatctgtataaattcaagtccttgaagcggagcttctgaggcttgcagtcagaccatttggataaatctagtatcagctgggaatttgcttaagcattttttcattgattacacagttctaccgtatttcactcaaatctactgctacagttcttctatggtattcatctccttttgaaatcatggtgatatggcttggacctgtgtccccacccaaatctcatgttcaattgtaattcccagtgttgcaggtggggcctggtgggaggcggttggattactggggtgggccattcatgaatggtttaacaccattcccttggttctgttcttgaaatagtgagtgagttcttgtgagatctggttgtttaaaagtgtgtggcaccttcctgccctctctctcttgctcctgtttctgccatttaagatgccgtgcttcagctttgcctttcaccatgattggaagcttcccgaggctcccagaagcagaagcctctatgcttcctgcacagtctgcagaatcatgagccaattaaacctcttttctttataaattactgagtctcaggtatctatagcaatgcaagaatagaccaatacacctggtgtggaaaatagattccctcaaaagaatggagggttgttacaatactaaggacaaggtttccgtggaaaaagtaaagaaagttaggaacagtgaaactgcttgctctatatttctgtttagacttcaggtagagtcagttagatgaatgggccaaaagaaccaggaaaaggaggaagatgcagcttgatcacagagatctgacacagggtaagagggaaaaggaggagagcctttgtatagagccaaataatatccagatctaaattttcttcccaagtttagagtttgttaacatttacaccttgctgcagaaccatgtagctgctgtctctgaattcatggagagtgaatattccaggaagcacaatggaaggcgtccaggttcaaagataaatggtagtggggctgacagaaaaacagcatccttcttaccaagtttgtcctgggaacatccagagatttttattataagtcgactaaacaagaatagtgagagttaacagcaattgttttagctactgtgacttcagtactaccatgaaaggagaatctgtgaggattggagttttttcctcatgctcatcccacaagtgcttcactgataccttgtctgtctgcttaggtcagtgttctcaaagattattttgtgaatgtgtataacactggctgtatgacaaacacctgaggagatttttaacttccaggatcttgattctgaacattttgattttgtaagtgaggagatctccaaatctgtattttaaagatgatcaccaactaactcttacatgaagagaagtgtcatccttgctatgattctatacatcagcagacatgtctctaccaatcctagaagctgagatgggctttttctttggtcttttgaggcaaatccaaattatttaagtatcttatcccgtggtaaaaataactattggtcaatagtattggtggatggacatatgtagggggtatataatcaaggctaaatttccattaaaaggttagtatcacaacactttgcctcatgcacataggccagtcacattatctgggaatcatttcttctcctacaggagaagaaagtgatgccagataattttgtagggatttaatgactttagttactatattttttcattataagagttatatattctttactttttaatcaatatatacacaagatataatttccttttttctttgaaaagaatttattaattggaaattacaattaatttatttctgtaattgatgccttaaatgtgaagcaatatgatatttcaagtagtaacaattcctcaaccaaagaccattcatttattcatgcatttgtgtatttaagaagtgtttcctaaccacctgctgagtgtttgacattgtactaggtatgggaatacagcagtgaaaaaaagcttaagtctctctcatctcaaataatctactaatgtttaaacatgtgctactgacattcctctggttttatcctaaaaaagtgctaatacggtattttagtggatcatgggttgggcaaagatggctaaataagaaaaggtaaaatgaattattctcagaaatgccatggtatgaaaagaacttgcaagtcagacagtgtgctgttaaaaaaaacagagttataaaaaagaccaactattctttagatatacaaagaactatcagacagctaataggtgtcttagaaaaaaaaaaaaagccagaagtgaagatacaggattgacttttgaaagaacagtcaacaatcctttgagtttaggatcttgcccacaaaggggtgcatcttcctaacacattcacatttcctgctcacgctcatttcttcagtgtgaccttaacttttcctcacactaagaagacaagacccaagggcaccagagggtctaaaaatgaattcttctccaggaccagcgattgcactattcttaatgtttggtaagtaaaatggcacttaaaacttagaatcttttgttccattatgttgatgtaatctgtaaccacagttttctctaacgggtacagctaagatcacgtctaaggtaacttggtataatttgtttatttttttttcagggggaatcaatggagattcagtggtccagacagaaggccaagtgctcccctctgaaggggattccctgattgtgaactgctcctatgaaaccacacagtacccttcccttttttggtatgtccaatatcctggagaaggtccacagctccacctgaaagccatgaaggccaatgacaagggaaggaacaaaggttttgaagccatgtaccgtaaagaaaccacttctttccacttggagaaagactcagttcaagagtcagactccgctgtgtacttctgtgctctgagtgacacagtgacagggactgcaggggaagctgagcacaaactctgagcagcacgaggggcctggctgctgagtgtaagccactgtgatcccctctggttagggaccaggaactactctactattgttgcccaccacccaccctaggcactcctagtgtgaaagccatccaaataaactctaaaacactatagaataactaaaagtaaaaatacctcacaccagatgctttaacaatgagagtgaaaacagaatgtcaccatagttcctcaaccttgtttgaaatttgtgattttaaaagtataaaaccttgagataaatgaaatggtctagctgctcatccctgtataaaatgtagcctcctgaccttgtctcaggccatccaaggaaatagtatgcttacagacacagctgtgacagatgaggttgcaaatgcttaatgcatacctgagtggggtatacattcagctggggcaagatggggtgatttcttaggaaagcttctgcccaagaaataataggttcttaaagaaaaaaagaattataaatggaagaagtcaaattttccttgtttgcagatgatatgattttatatttggaaaaacatagagactccacaaaaaaaccttagaactaaaaattcagtaaagttgcaaaatacagaatcaacctataaaaatcagtagcatttctatatgtcaacaataaacaacccgaaaaagaaataaaaaagtaatcgcatttatgatagccatgaataaaattaaataactagggattaacttaaccgaagaagtgaagatctctataatgaaaagtataaaacattgatgaaagaaatcgaagaaaacaccaaaaaaaatactccgtgttcatggattgtaagaattaatattgataaaatgtccatactaccccaaacagtctacagattcagtacaatccctaaaaaaataccaatgacattcttcacagaaatagaaaaaaaatcctaaaatttatatggaaccacaaaagacccagaatagccaaagttatcctaaacaaaaagaacaaaactggaagaataactttacctgactttaaattgtactacagagctatggtacatgaaaacagcatggtactgtcataaaatcagatacatagaccaatggaacagaatagagaacccagaaacaaattcacatatctacagtgaactcatttttgacaaaggtgccaagaacatacactggggaaatgacagtctcttccataaatggtgctgggaaaactgtatatccatgtgcagaaggatgaaactagacccctgtctttcaccatatgcaaaaataaaatcaaaatggattaaagacttaaatttagatcacaaactctggaactactacaagaaaacactgggggaaatctccaggacattggtctgggcaaacatttcttgagcaatatcccacaagcacaggcaaccaaagtaaaaaggggcaaatgttatcacatcaagttaaaataccctacacagcgaaagatacaatcaacaacgtgaaaagacaatacacagagtggtgaaaaatatttgcaaactacccatcttacaagggattaataaccagaatatatgaggagctcaaacaactctataggaaaagatgaaataatctgattaaaaaaacaggtaaagatttacatagacatttctcaaaagaagatgtacaaattgtaaatgggcatatgaaagggtttttgacatcattgaccatcagagaaatgcaaatcaaaactaaaacgagatagcatctcatcccagttaaaatgatttacaagaaaaaaacaaacaaccccatcaaaaagtgggtgaaggatatgaacagacgcttctcaaaagaagacatttatgcagccaaaaacacatgaaaaaatgctcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggattgtaaactagttcaaccattggggaagtcagtgtggtgattcctcagggatctagaactagaaataccatttgacccagccatcccattactggctatatatccaaaggactataaatcatactgctataaagacacacacacacgtgtttattgtggcactattcacaatagcaaagacttggaactaagccaaatgtccaacaatgatagactggattaagaaaatgtggcacatatacaccatggaatattttgcagccataaaaaatgatgagttcatgtcctttgttgggacatggatgaagctggaaaccataattctcagcaaactatcgcaaagacaaaaagccaaacactgcatgttctcactcataggtgggaattgaacaatgagaacacatggacacaggaaggggaacatcacacaccggagactgttgtgggtgggggaaggggggagggatagcattaggagatatatctaatgctaaatgacgagttaatgggtgcagcacaccaacatggcacatgtatacatatgtaacaaacctgcacgttgtgcacatgtaccctaaaacttaaagtataataataataaaataaaattaaaaaataaaatgtcttatatccaaaagacaggcaataacaaatgctggccaagatgtgaggaaaagggaaccctcgtacactatcgattggaatataaaatagtacaatcactatggagaacagttttagtttcctcaaaaaactaaaaatagagctactatgtgatccagctgggtatatacccaaagaaaggaaattagtatatcaaggagatatctgtaccccccgtttgttgcagcactgttcacaatagctaagatttggaagcaacctaagtgttcatcaacagatgaatggataaagaaaatgtggtacatatatgcaatagtaccattcagccataaaaaagaatgagattctgtcatttgcaactacgtggatgaaactggagatcattatgctaagtaaaataagccaggcacagaaagacaaatatcacatgttcttacttatttgggggatctaaaaatcaaaacaattgaaatcaggaacatagagagtaggaggatggtctgaggctgcaaagtagtggggtgggagagggagatggggatggttaatgggtaccaaaaattagaaagaataagacccaccatttgatagcacaacagggtgactatagtcaacaataattgtacatttaaaaataactaaaagagtgtaattgaattatttgcaacacaaaggataaatgcttgaggagaaggacaccctattctccatgacgtgactagttcacattgcatgcctgtatcaaaacatctcatgtactccatgatatatacacctagcatgcacctccaaaaagtaaaaataaaaataagtaaaaatttaaaaatcattaattaaaaaagaaatataagaaataatggagaaggagagagtagaacatgtgatcacatatatggaaaaagaagatggaacatttcttagtttctattttgggaaattacatgacatgcatagactggttttgcccaaaagatgaaactaatccctaaaaaatatgactcatggccaggcatgatggctcatgcctgtaatcccagcattttggcaggctgaggtgggtggattacctgaggtcaggagtttgagaccagggtggtaaaccccatctctactacaaatacaaaaattagctaggtgtggtggtggttgcctgtaatcccagctacctgggaggttgaggcaagagaatcacttgaacttgggagacagagattgcagtgagccaagactgtgccactgcactccagcctgggcaatagagagatactctgtctcaaaaaaaaaaaaaaaaatgactcatgcctaaaagataccttgctgagatattatgacagtagagaattttagtttgcatgatatctcagcaagatggctttctctcactaagacattacttaagatatataggtagtgttcagagtctggaagatgcaaactattgagatgaaactttttctatgtagattggtgtgagaaaggaatcttatagcttccccaatgtctttcaagccatttcttctacagaaggggagtaacagatgaagtggtagatggcggccagggctatgagaagataaagaatggcaaaaagaagaatttttggatttaattgcagatatcttggcatctttgctaacattggagattttcttttgcttgtctattgaaggtgcttaactcatatcaatcagtttattgacccataaggagtgcatttttgctcattataagggtccttaagcacaaaaagtgagagtaagaggatggtatgcaagatcccctgtttcacaggctacaaaggaatggaactattcagattagtgatataataattgacactgaagatgccttgactttgactctttcatttttcatgatcaccctgctttagtttctctcttagcttttaattttattccaaaggcctcaatttagatcttattagttagttgagctaataactacctatacaaaataaataatttatgtacatgggaaaaataactttagatggttcaaatgactatgcaaaatatctctgacttttggctaccacatggccaggttacaaattttccaaacttttttggcctgctttccttttacatataagttccaatttcagatcctttctttgctcacagatataagcataggctgttacaagcagccaggccacatcttaaacactttgctgcttagaaatctcttctgccagataccctaaatcatcactctcaagttcaaagttccacatatccctagggcagagacacaatgtggccaagctctttgctaaagcaaaacaaaagtgacctttgctccagttctcaataagttcttcacttccatctgacatctcatctgcctggactttgcagtccatgtaactatcagcattttggtcacaaccattagacaagtatctaggaagttccaaactttcccccatcttcctgtcttcttctgacccctccaaactgttccaacctccaactgttacacagttccaaagtcgcttccacatttttggttatcctttcagcaacacctcactcctggtaccaatttactgtattagtctgttttcatgctgctgataaagacatacccaagactgggaaatttacaaaagaaagaggtttaattggacttacagttccatgtggctggaaaagcctcacaatcatggcagaaggcaaggaagggcaagttatgtcttacatggacggcagcacgcaaagagaacttgtgcaggaaaacttccccttataatagccatcagatctcttgagacttactatcatgagaacagcatgggaaagacttgcccccataattcaattactttccactgggccctcccacaacatgtgagaattcaagatgagattttggtggggacacaaccaaaccatatcaacttctttacttactaatatgcatttaaggtttctaagtgcttttcatgtcttgatagctcatttctttttagtagtgaataatattccattgtctggatataccatattttatttatccatttacctcctgaagggcatcttggttggttctaagttttggcaattattaatatagctggtataaatatctctttgcaggttttggtgtagacataagttttaactacttttggtaattaccaaggagcacaactgctggactgtatggcaatggtatgtttagttttgtaagaagctgccaaactgtctcttaaaatggctgtaccattttgcattctcaccagtaataaatgagatttcctgttgttccacatgctcatcagcatttgatgttgttggaggtctggaacttgggcattggaatagaagtgtcagggtatctcattgttttaatttacgttttcccaatggcatatgataaaaagcatcttttcatatgttcatttgtcatttgtgtatcttccttggtgaagtgtctgtcaaggtctttggcccattttttaatcaggtcgtttgttttcttattattgaattttaagtcttcttgtatattttggataacaattctttttttttttttttttttgcaaatactttctcccactctctggtttttcttctcattttcttgacattgttttttacaaggtagaaatttaaatttttatgaagctcagtttattattgatttctttcatggaccatgcatattgtgttgcatttaatgactcattcccatgctgaaagtcatctaggttttcttctatattatcttttggagttttacagttttgcattttacatttaggtttataatacattttgagttaatttttgaagactgtaatgtctgtgtctatattcattttcatatgtatatatattttttgcctgtggatatccagttgttcctgcatcatttgttaaaaagactatctttgccccactgtattccctttgtttctttatcaaaaatcagttgactttgtgtatgcaggtatatttataggttctctattctgttccattgatctatttgtctcttctttcataaatgacacactttcttaattaatgtagctttatgttaggctttgaaattaggtaatgtcagtcctttgatttgttcatgtctttcagaattgtgtttgttattctggttttttgcctttccatatatgctgtaaaaagaattcatcagagtccctccaaaaatcttgctggacttttgattgttattacaccgaacctgtagatcaagctgggaaggataaacattttgactatattgagtcttcttatttatgaacatggaattcttcatttctgtagttgtcctttgatttctttcatcagagttttatagttttctttatgtagatcttgtaaatattttgctagatttatacctacatattttaccttttgggtgccaatgtaattgttttctgtttttagctcaaattccacttgtttattgctggtatataagaaaatgaatatgtatataatgtatataataataaataattacttatatacaatatatcatattttatatgttaaccttgcatcctgcaacgttgatactattgcttactagttccaggagttttctttttgtcaattcttttggatttttttatgttgatgatcatgtcatctgggaagaaagttttattttttcctgcccaatctgtatagcttttcttttcttgtcttgtcttattgcagtagctaggactcctgatatgatgctgaaaaggagtagagagaagggacatccctttcctgatcttagtgagaaaacttcagttttctcattatcaggtatgatgttagctgtaggttttggtagacactgtttactgtattgagaaagttcttctctattcttgttttactgagttttttttttgttatgattaggtgttgaattttcctaaatgctttttctgcatcattgataagatcatgtgatttttcctctttagcctgttaatgtgatgaattacattaaatgactttcaaatctgaaccagtcttgctatttgttgcccttgttctttgttcttattctgtcttccactctttttttttttttaataattccttttctggtttttttaaggattttttttttaatctatgattttcttttttcttttattttggtggtggtggaggtggggacacagtctcactgtgcccaggctggagtatagtgatgtgatcttggctaactacagcctcaacctcttgggctcaagtgatcctcctgcctcagtctccagagtagctgggaccacaggcatgcaccaccacgtccagctaatttttgtattttttttttttttttttgtagagatggggttttgccaagttgccctggctggtctccaaatcctgagctcaagtgattcacccaccctggcctcctgaagtgctggaattacaggcatgaaccactgtgcccagcctatctatgattttctataatttgaataggaaatatttaggtattttgttttgttttggtatatatcttgctgtgtgttctctgagcttcctggatctgtggtttggtgtctgacattatctggggggtaattctcagtcattgtctaaaaaaaatcttttttgattaatttctctctttcttctctatctgatattccccgtatgtatatgtgatactttttgcaactgccctacagtttttagatttttttccattttttcttttgtctttgttttctttgcttttcagttttagatgtttctactgatctgtccttaatctcagaaattctttccttggctgtgtcccgtctactaataagctgatcaatgatattcttcatttctgtgacagtattttgatctctagaaattttttgttctttcttaggatttccatctctgttacattgcccatctgttctggcatgctgtctactttattattagagctcttagcatatttgttttaaattcctggtctgataattccaacacccccgatgtgtttctctgatgcttgctctgtctcttcagattgtttttgccttttaatatgccctgtaatttttttcttgatagccagacatgatgtactgggtaaaaggaactgctgtaaatatgctgttagtgctgtggtggtaaggtgtgtggggaggggaagtgttctataggcctacaatttgttctcagtctttgagtgagcctctgggctgtaaacttctccagtgtttcttagtctccctcactcctcacacaccctttagctgggaaagaactcaagggtgggctgaagttgggtatttctcttccaccaggtcagttaacctctgataaaaccccaacaggttaggctttggttaactggtttctcctgagggcagaactttgttaaggacagagtgctgcagtgtatttcagaattattccttttcctctatccatgctggaagtgcaaggggatttttctgtgatatttactgtggaagcctggtcaagttgctgaagataaaacttataaaagtgtggccccagcctccccaccccatgactcagccttcctggagtttttgactctcagacttgtcctttctgagcctaaaacagttttcaaaatacagttgaggttttcctacctcagcaatggttcccataaatgcttctgcttctgagtctttgttccagtaagccacgactccctgcattcacctaattgtccaatcctgggggcagtggtatgcccgatgtcctcacctttattatggatccaagatgaattgttgaattttcagtctgttctgctttttacttattaggagtgagtggcaactttaaagctccttacatgcagaaccagaaactagaaatcatctgttattgtctttttaatataaattttgaagaacattctctatattaagaaaacttgtcatataaccatcatataatgtatacctatatcttcttaaaaagtgtattatcattttgactttacttatgatcttgtttgtcatgcagaatttaaaaaatactatatagtcaaatttatcaaaacttttttcatggactgtgagttataagccctgcttaaaaatccataccactccaaaatggtaaaattttatactgtattttctttagtttttcagacttttttgtatttaaatttttaataagagtgtgtatgtaaaaaatgaggttgatgtccagggatttttatttttcttatttttttggttcattttgaggctgccactcatgctcaacatccttttctgaataactcatttttcttcattgatttaaaatgttatatttgtccattttccacgtttcttatttttcgctattaaggttttcaacttaagcattaaaaaaatccaaaatggattgtttattgttaatggtgcataataccaatagcttactgaatatgagagtaatatgcagccagtcatcactgagctcatgctagaaataagtatgggattatgatgtgaatagaaggaatgttactagaaatggagaaagagataaactgtgagagtgtgtagtgaggtgtcacctaaggcaatgtaaactatatgcctgtaatctcaaacttgtcagttgtttccagttgagaggactcagacaaagcagtagaaaatcatgctcataaattgttcactgagtaagaagtagacaaccagctttggaaaacaatgacaacttggtatcttctttgttcttcttgaagaggagaaattaaatagtcaacacttggttttagagttctgacaagttccaactagttgaaatgccttggaatttgcagctacttcaagtttgggatgctgtcattgttctggaagaagatttttgaattttttctgttaccacatatgctccttgatgatgtttagttatatccactgtggaaactatcatagctctctgagaatgttgttgaaaattgattatatttcaaatatagtgcccctaatttaagccgaatgagtatggacaggtcttttttgctgagatttcttcttcctgcctctccctctccttcaccctcttgttcctctctctgtcctctgtcctcttttctttctcttccttgactttgctggactgattccatgatcctttcctgaagtaagcatctctgggggatcaacccttactttggactacaatgccattgccatcaatatttaaaagtaatctcaccataagataccatctcacaccagatagaatggtgattattaaaaagtcaggaaacaaccgatgccattgaggatgtggagaaataggaatgcttttacactgttggtgggagtgtaaattatttcaatcatcgtggaagatggtgtggcgattcctcaaagatctagaaccagaaataccatttgacccagtaaccccattactggatatatacccaaaggattagaaatcattctactataaagacacacaaacatatgtttattgcagcactatttacaatcgcaaagactgggaaccaacccaaatgcccatcaatgatagactggataaagaaaatgtggcacatgtacaccatggaatactatgcagccataaaaaagaatgagttcatgtcctttgcagggacatggatgaagctggaagctatcattctcagcaaactaacataggaatagaaaatgaaaaaccagccagtcacagtggctcatgcctataatcccagcactttgggaggccaaggtgggtggatcacctgaggtcaggagttcaagaccagcctggccaacatggtgaaaccccatctctactaaaaatacaaaaaattagctgggcgtggtggtgggtgcctgtaatcctggttacttgggaggctgaggtaggagaatcacttgaacctgggaggtggaggttgcagtgagccgaggtcatgccattgcactccagcctgggcagcaagagcaaaactctgtttaaaaaaagaaaaaaagaaaagaaaactgaacaccgcattttctcattcacaagtgggaggtaaaaaatgagaacacatgaacacagggagggaacatcacacaccggagccagtcgggggttagggggagagcagagggagagcattaggacaaatacctaatgcatgtggggcttaaaacctggatgatgggttgataagtacggcaaaccaccatggcacatgtatacctatgtaacaaacctgcacgttctgcacaagtatcccagaacttaaaaaaaaaaaaagtaatctcattgtaaaggaaagcagctgttcacaagagcatataaaactaacaatggatctatattatttaggttcacgcagatttaagactgtgatgtctacatgcaactctctgtatatatctatctgtattgatagagatatgtacatatctatatctgtatctatctatctatatagagagatttattttaaggaatagtttcacacaattttaggggctgggaagtccaacttctgcagggcaggtcgtcaggctgggcaacctgggaatcactgattttgcagtttgagtttgaagacaagtctggaggcataatttcttcttctttggagagcctaagtgtttttcccttaagaccttcaactgattgaatgaggtccattcacattatgcagaaaatctgcattactcaaagtctactgattcaaatattaatctcatctaaaaacaccttcacagtgacatctagactgatgttggaccaaatatctgggtactggggcctatctcagtggatgcataaaattagccatcacacggtctttacctctagcaaatcttttccaaaagcctactttgcttatacaactataatataccaactttctttttattgtttcttgtataactatttccattctttcaacttctctgagctttaaatttcaaacttaaaataaatcctcatatatctacactctcaactgttcataagcttcttatttcactgagaaaatagaaacaatcagaagagaattttcaaaaacttcaacacttaccagtcacttgcatctatgctcaaatactctgtctttcctctcattagaatgtcatcccctgtgtgcagggactttgcttattctcagcacttatcatcatacctgaaaatgtaggcatttgaaaaataattgttgaattaaaaatgaataataaaaataactctgtcattaccagaacaaaactatcatttattcattccctcaataaaaatttattatatgcctatttattgacaggccttattctagcaactgacaatgtagcagagaatagaacagataaaagtccctatcctaagggagcttatatttcagttgaaggctaagttcatgttagccactacaataagcctttacatgaatcatctcttcaatctttcaaaaattgttaggtaagtgttatcatacctattttcagatgagaaagctaaggctcaactctcctatttaatatcacatagagccagaatgcagagcttcaaatatatgtctaaattactaatctactgtgctgatatagacatgaagggctttatcctctatatcatgctgcaaataggaggaaaaaagcttgatcaaaagttctaagcaattgtagctctgaccccaagagggcagtatttgcattcgccccgcctgcaggtctgaatgtgtagtatgtgtaacatagcgaagcctggtctctgattggctagggataccctctgagaaaccctttggttagtgttaaaaaaaaagagaagatgttgaatacacaagtcaacttctgggagcagatctctgcagaataaaaatgaaaaagcatctgacgaccttcttggtgattttgtggctttatttttatagtaagttagtggagagttttagcaaagttaacatagtaagtcaagggaatattttcttaggatttggggtgaagatgtagtccactgggataggaggaagggagaaaatgggaccattttctgtttcacttgggattcattgtggggagtaaggaagggatgcaaattagacagtattaatactggatgatggatctcttgaatctcacttttctttctgaataggggggaatggcaaaaaccaagtggagcagagtcctcagtccctgatcatcctggagggaaagaactgcactcttcaatgcaattatacagtgagccccttcagcaacttaaggtggtataagcaagatacggggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagcgcactgtgctccacaggcacttgaagccagtatgcaaacctgcacctggaggttatcaaggaggcataggagttagagtagaccgttattttttatgcagaatatgatttcactagtgaatatttatctctccgacatgatttgatttgagcttgagcctaaagttctacttaggctcaagtagaatacatgtcctcaagcgaggataaagacattctcactcaacacacaaagttaattgctacatctgggtgttcccaagggcaagacagtctgtcatgctgtgttactattgctgaagtagatgacagtgttgtttggaagggagagactagcttggtttttgatctggacacctaccagcagaatgtcaactaagtgaaagagcaacaagtttatgtggctgatggaaatttttttttttttttttttttttttttgagatggagtctcactcagtcgcccaggctggagtgcagtggcgtgatttcggctcactgcaagctccacctcccgggttcatgccattctcctgcttcagcctcctgagtagctgggactacaggcgcccaccaccacgcccggctaatttttttgtatttttagtagagatggggtttcaccgtgttagccaggatggtctcgatctcctgacctcgtgatccacccatcttggcctcccaaagtgctgggattacaggcgtgagccactgctcctggccggaaatatcttgagaagtttccttcccctgaaagacattcagttgtcatttcatggctattcaagttctcagaaagcatcctgtgagaataaatctgctcttcccatttagctatgctccagatcaaggcttttgtccaggtgctgcatcaactctttattatcttccatcactgctcctttagaggacactggaaggccaggggatcctggcagacacagtcactctcaggcagcagaacaactgtgccaggcttttcaaccatcagtgttctagaaaagagacttagggacagaatgcctacctgcaattgtgaactctggttttcacaacttagctgtgaagttctttttgggacaattagagaaatgtacatataatttgagaattagatgagaaaagtacttatttaaaaggcagatatcaactgtaaaaaaatgggaagaatatatactaagatattaaaaatggtaatccttgtattgtgggaatataatgtttttactttttatctttccttgtcttctgtacttttaattttctatagttctcggatttttcttctgtcaaaataaagattattaaaaaataacaaatgtcttaaaaaatttaaaggaatgcatctcatctgtcactatcaactcacaggaattgatatttaaagatgatcacacatttcaggatattgttgaataagattgatttgttatgcttatgagcactgcaagtaagttcatttccaagttcagtgaattgataatttgtgaataaatgaagccaggacctggactgttctttgtaactagtctggagatagctcaagtgtcaagacatcaaaatgccttgacttctggagcaaaaagtaaacctagatatattcagtaatcagatattttttcctgtcctgtatctcctttcaagtctttagagtgaagaaattaaagttcagattgctgctacagcagacttgtgtgagtaatcataaactaattgaggaaaaagataaaatacatgaaaatggaatcaataggtaaaattccaagtacgtggacaaataagttttaaaggtattctcaggaggagattactgtgggacagaaaagataggagaaagtatcatggggaatagcaaatttagttaggtcttgaaggagagacacacattgaatttgttcattacacaattatttattaaacaaataatgaggccaggtgccgtggctcatgcttgtaatcccagcactttgggaggccaaggtgggcgaatcacttgaagtcaggcattcgagaccagcctggccaacatgaagaaaccctgtctctactaaaaatacaaaaattagccaggcatggtggcatgcacctgtaatcccagctactagggaggctgaggcaggagaatatcttgaacccaggaggcggaggttgcagtgagctgtgattgcacatctgcactccagcctgggcgatggaatgagagtctgtctcaaacaaaacaaaacgaaataaaaaacaaataataagtgacaggtgtttttgtaggtagaaggagtagggtaataaacaaaatagataaatgcagacacaaaagaccttccattacgaggcttgagtctatgtttgtctattgcgttcactttcttttacaggaatatcttgggaagtttgcattccaatataggcatttccttgcttgctttagtttagtttagtttgcaggtttcatatggtgagtaaaaggcacaggcattgaaatgctctatctatcacttactaaattgcattactctggacaaaattacataacttcagagcacctacgcgccatcaatggtaattacacgtacatcacatggtcataaggattgaattaagttaagtgaatttaattaaatgattgaattgcattggtagaaaataatttttcaactaatggtagttattcttggacataaatgataaaacaaaggtaatttaaaataagacaataagaaactttaagtatagattaaggtttgcctttccactcttcttctgttgattatattcttttactacagttatggccgagagtcaccctttatttcacattggccttattccattcaattatttgaactgacagtattggctttcttgtttgtttgtttgtttgtttgtttttatctcataggttttctgcacagaaaatgaagctttcttgcttccggtgtaatttaatgtaaattctatgatgaatccacatgagctttatggagcaggactccgatataacaccattatactgacctacagtgccaataactagatccatacccaggagctcatttaacagagctctgcattggaaaggagagaaagtaacctttctaggtttgggggagaaatcctttttagttattcaatttataacttgtacatacatggtagatgcccaggaagtattacagaagaaaaaaggaaagagaaaaatctaagggacaaatgctagatgcagctgactgagaatcagcacctggttctgccagggtccttttccatgctacctcttcagagatcaggaggagctgtgtgatctgtgcaccggggagtaaatcttgtttctggctggttggggagactttcagcttcctgcaacaaagaactatgaatgttaactcagagaaaccagagatttggcttgatagtgtttgagggctcccagaccccagccagagacctcactgagtctaagtgataaaaacggagaagcccttgggagtttcattcttgatttcctcctggcagctgtgctgtgagttgctgggctctggaaatatcataaaaaagagcagattgtagtttcttctttataagtctggaagttatagaagggtggttagggtctcagtgctcacctgtgggggctgtgaaaagagagtatatcttccaaatgaatgaatttccgtgaatgaatgtcctctgtctgtggttctctgtttaaacaggggtgaatagactacatacactggagcagagtccttcattcctgaatattcaggagggaatgcatgccgttcttaattgtacttatcaggagagaacactcttcaatttccactggttccggcaggatccggggagaagacttgtgtctttgaccttaattcaatcaagccagaaggagcagggagacaaatattttaaagaactgcttggaaaagaaaaattttatagtgtttggaatatcgcagcctctcatctgggagattcagccacctacttctgtgctttgcagtagtgtctccccagcacctgcagcctgtaccataacctgcagccgggacccttgacacaggctagccttgcaggtgggagtgaagatttttttttttttttgtatagagggaactttctttatgacccgcatctccaaaatagaagtgaaggataatgtatctttcttatgtaatgaaactgaatttatattaaattaaatttccttttgttattatttaaatttcattccttgatgcagtttgtacagattctgagcctgtttgcccacagattccttccactgctttactctttaagaggaaagacccctttgtggtgcaggctctgagtccatgaagcaagttttctccaggctataccctcatcaggaacattttacccatttgatcatatcttcatgatgtttttgtaccatctataccattatttacttaatttaatattaaattgatgtttatgttaaatagactttaaaaataactgtaaaattgtcttcattttaccagataccatctgtgaaaccatgtatatgatataaataatatatttaaagtgctgcttatatttttcccaatataaattaaaatagcatcatatatgtaacaattgaaaaggctgtctgtatactgcctaataggacctcttgtatcaatcacactttaagaaatactgatccagcccatacccctcatttcataaatgaaagaattgagatccacaagtatggtatcatttactcaagcacgacttacagtaaaatgaaagctataaaaagagtctaggctttatgatcccttgtcagttgcttcttccaccaatgatgcaaagcaggatctaaagtttgaagaaaagagttgcgtgttttacatttaaattaaattaaaagttttatttaattgtgtatgttcaacctaggtaaattagaagatacgactacctatcaaagtagagcattctcataacttcatcgcctagaaataacaagtatttatttttcaaattttcttgtatacatatacaactacatttctctatgaatggggctgataatgtccccagtatttattaatgtgcttgcttctctcaacattatagatatttccatgccagggatcttatattgaggatataattttaaatgactgtctagttttcattatatattttttaaaaagtgaatcaccttttgataatatttctaattatccagtattatagacaatgtttttattaacatcattcaagtcacagctttcacagaatggagttgggtgaataagggaaaacacataacactgcatatctaattttcaggaagaaatttttcaccaaattgtgattccaacaatagcatgtaatgctttttgttttccatactttctttacctgttatgaacattattacttgaaagaagtttccactttgccaagtaaaatttttaaatgttttgactcttttactctatgaagttatacatttgttattaaaaataaatgaaacaggattagaaaacatacagagtaagagtgtttcacacaacataagtatcttcatacaataagatatgttaaagaagaactttgaaaaacactctcatggtcccatttaccttccaatgttctctttcctttcaaggctatctattctccacgtcgttcctactgtaagtgtggaccagcactatctgaacttgtgcggaatctcaggctgactgaatttgaatctgcattttaacagaccaaccgtgtcattctatccttcaaagtttgagaagcacccctttcatggggtgccagaatgattttttacaatataaagtaaaagctgtctctactagcccaaaaatgcttcaatggctttctattgcttctagaataaaaatgcaaatttcaggctgtgctacacaaagatatgtatcatgtgaacctccttttcaatctccccttttaactctcctagctctctatgtagcaataacactattctcctttcagtattctgaacttgccatgttcttttccacatttagtcaaactcgtccatttgaaatgctcttcctccaaatatgggcaagcccaattcattttcacatttcagatctcagctcaagtacacactatatagataaagacttctgacttctgttgatcttcgtgactaacgtagccatccatggctctccccacagctttatcacaaaaccctagttatttcccttatggtaataatcataacatctagttataatgttgatttacatgccaatgtgttcattgcctaaacttccaattaggatacaacttctatgaggtcagggatattgtttgtttaatcacacctttaactttagtgcctacctttagtgactgccccataatagtcagtgaaaaaatatcttctgcatgtggctgggcgtggtggctcatgtttgtaattccagtactttgggaggccgaggtggaaggatcagttgaggtcaggagttaaggaccagcctaggcaacatagtgagaccctcatctctacaaaaaacaaaaataaaatattaaatgagtgtggtggcatgcgcctgcagtcctagctactcaagacgttcagacagaaggatatcttgagcccaagagttggaggctgcagtgagctatgatggtgccactgcacttcagctctgggtgacaaagcaagacctcatctcttaaaaaataaaataaaataaaataaaaaagaactatatacagaatgaataaatgaatgttgcttggccttgcgttcttttttcctttcgctttcttctcactcccatcctagcaaatctgaacttcgtgtatgtgctccctgctcagatatctggtagagttctttaatgctggcacttaccccttgtctccggaccaggccttcctatgctcagtgaactctgtcaaataactagatcaactcagggtctcaatctgtcctcactcaattgacatcaggtgtaatctgaatgaaccgagcaaactctaaacataatcccacagtaaaacatctgaaagaaaaaaaaggtatacttaaaagatgttggaaagtatgaaatcaacttcccaaatcaaataaatgataagcacatgtcaaagtttaatctcaaattattgcaagagaaaaattgcatcaggaaacacattcaaataattggactaagtagagacattttatagaaactaggtttttttttaaagtcaatttaaagataattattatggtcaaattattattggttcataatgactgtactctgtgtagtggttgttagactcatcatgagattaatagtcatctgagattataacactaatatctcagaatgagtctttattttagtaaagaatatcagaaaattgatcaaatatttgatcaggtatgatagttaattcccatatggggctatacattttatccttcaaaaaagtttcattcaagaccagttttgggaaatttattgttgtcaaaagtaattcaaaccaagtgtggtgatgtgtgcctgcagtcccaggtactcaggaagctgaggtgggaggatcccttgagcccgggagttcaagtccaacctgggcaatatagtgaaacctcttctgtcttaaaaaaaaaaaaaaaggtaattcaagtctttagtctttactataatggagaggagggatttgtcaggttttggatgttttcccttcctacaagttactaatcttgtttgattgaggctacagtaaatatatgaaactacttagagacaaaggattttgttactcatgacacagcaaacagcataaacattgttatattcacttcagtcgttctttcccttaaatctaaaaaagatgatatgtatgctgacgaatactttgtttgaagtggtactgtgtcataactgaggaactttgagctcggagaattcactgcttttatagtaaggagtaaaccaaattgctctttgtctcagagggaaacagtacctcacccctcaaggtttcttgctgcaagcataactctggaaattggtcaggtagagtggtcatggtcgtaaaccactggcatacctagcaagacatttatgagtataagagattaaggatggtctggttttcaacaatatccactccatattcttacattgtgttattttctagaaacttttctcatgagtgtgccactccagaagccgttctgatcaatttgacagacagagattccgagactaaatacattgaatttgcctcaaacaatgtttaaataaggctactatcagcagaccaatctgcaacattaacttcacccatttagtcagctgtgacaaagtcccaaagtatagataactaggatataatttcttatccattatacatggaagtttagattgatacgctaatctttgttttaattctcaaaaagagtccaaaaagtagccaccattcctaatggaaagatgttctgtcccacctattcccagacataagcataacccaacaggttaatccagtttggaatttattgttaaacttgatttggatcagcattacatcacttttgttgtaggatccttggggtgttgcttttctgaccagaaacctctgtggttggtggtgcctttactcaagttttgcatgggccccctggactcattccacttacttggcctggaagactatgctcagctcatgctaccggcctggatcttatgcttgccaagggcgagtcaggcatggagcagtaagggatgtgtgaggaagtgtggggtcttgccactgcacagtcagacatgctggctgctgcagtgaggtgggcagtgctggcatgggtgccagctgtctacaagactgaggctagaccagttgcactgcaagcagcattgactgctggcactggggaacacggtggcactcaaaagcttggagatgccaggaaccatagggtcccaaagaggggggtcatagccctgacttggggagctctcaggtctgggcttcccacagggccacagcacttctctccttttttttacccacaatgtggcaaacacgggacatgtttcagccctgtttgtggaacagctcttttagccccaccatttgatgggttccaagttcttgtcctgcaaccaggaagaatgaggtacacagtcaagtggagggtgagcaagatgaagtagagctttattaagtgatagaacagctcagaggagacctgcattgggtagcttctttccacagctagggtgttccaatgagtgttcagctcgtagcagagaggagaccctggagtgggaaactcctctctgcaggcaggctgtcctgttgtctctgtagctctcagcacagaggaggccctggggtgggtagctcctctctgcagctggttgtcccagtgtctgcagctctcaatagagaggaaggcttgtagtggttagctcctttctgctgctggtcatcctgaggtctgctcagctctggctgagcctggggcttttatgggcctcagaagggaggaagtgcatgcccaatttatccatgggcagccatgggcaggcccagaaaaggcaccacaagttcccattccagtctgtgggactggcagcctgacacccagccttcaggccctccttggcctgaaggtgtgacctcactggggacccaccacttccacccagaaacctgtctgcctcctactgtcattcttagtgcccagatggtaggtgccaaggagtgccttcaggccagtgcccccttggcttccctcttatgcttgtcagtgcccaaaatctggagggtgtcaaggtggcagagggctggtgtgtgaacacttcccctagtgtgtgcacactctactgtgctgcaacagtgcctgggcttggcctcaactttgctctgagatcagagtggatgctgacaacaaggagaagccaggcagtgagagtgggtacttctgagcctgtgaaggcagggagggcttcccaggccctcaagagtacagagaagcctcggtccacagctgcagtttgggaagctgtagctgcccacagagggaggttgagggggcaatgctcctgcctgccccatggagcagaagtcctgggtttgcagccttgacttgggtggctgcagcttcactgagaagggtggggctcctgcctgctcctggtttccccaagagcatagggaggcctaggtctgcagtcacgacttgggaagctgcagctgtgcctggaagggcagggttccctcctgctcctgggcagagaagacagtgatgcccctgaagctgtggcttgggcagctgcagggcacctggggagctcctgctccaactcagaaggggcagggctcctgcttgtccctggttccatggagtatgcagccccagccatgcctccctgctgtgatagtagtggccactccagatggcccgctgctgccatcacttttgttaagctatatgagcagtgccattgagtatttgcaacctctgtagccattcatggcataacccaagacttttcagacatcaggagaagcatatacatttgtatgagtcagattgagacaaagttgtactgatttctatgtttgtacacagacaaggatgaagaatctatgttgggaagctgctattgatgtatgtattgcagaaattttcaggacaggccatattcacaggagttttactatttcaaggaatgtggaagaagatgacaaaccaagagcagattggatagccagctgcagctgccgcttggctccagcagaccatataattgtcttgctaggctgtggtgcttgacctagaatacaaagagtgaattaattctccgctcctccacctcccggtctaagattttcccttcctaggtgccagtgttattgctctttgtccaccatcacaaaatcggttcatcccattctagtagctataactttgccttttttttgtagtcagttcctagtcacaccaaaatcatttgcctagaacaaatagaaagaggaacaggcatttgtatgacatttacagagattcatcataattaccaccttggccttcctggaaaactgaacgggaacttgtaaagctgtgcactcaaataaatgctggttatcctcatgatgtaaaatcatgtttaaccaagaaaagaatataggtggctgaactggaattcaatattaataccattctgacaatgttgctgcctggagagtgtaccaaccaggctgttctaaggtcgctgttcggagaaagaaagaagcatcatgcctttcacttctagaatgttagaggaggtgtacttttttctattactgttagatacagctaaaaattctggacattatagatgttccttgaattgaaatgagattacttcccagtaaactgattgtagtttaaaataccataggtataaaatgcatttaatacatcttatatactggacatcataagatttcctatcctatgttaatcatgctcagaacacttacattagcctatggttgggcaaaatcatctaacacaaagcctattttataacaaagtgttgagtatctcatctagtttattgaataaagtacccaaagagaataatagaaaggttgtattggtacacaaagtgcagtttgttctgattgggtattgcttttgcaccatgaaaaaaatcataagtcaagtcatcattaagttagggaccatttgtatataaaatcaaaagataaaaagtttctaaaagatagagagaaaaagccagattgtctaagaaatttaggacctgaacaatgctagaacagtgagtttcatgagtttccttttgcctcatacaaaccagtggcatccaggagtagccagtaacctggtaatgccggtgggtacagaaaagaaatcccaaagaaatgccgttttctgtagccaaaggaccagggaaaggattgactatgaaggcagaaactataagaccataaccattctactctagccaaagaccacaaaaagttttatagcaaccaagcatacatttaatcaacaaaaagttaactgcaacgtagcaggagagatttgtgatagtgtaactttcttttgctccatctttccatcactggcttgaaaatagtctttaaatggcatccggcattcccagtgtgggtgtctggggctggaggaagcagagtagacccgttatcaaagaatagtgcctgactatgttgacctgtcaggtggttttctgaagggctaattcaaagggctttcctgtattcatataactcaaaaccctctcagagtggagaagaagtggctatgcagaggaaattttaaaaaaaaattgataaagggactcagtagcaggaaggagaaagaatctgcaaatgtgaagataggccaattgaaattattcagtctaagaagcggaagggaaaaaaattgaagagagcttaatagacctgcgggacattataaaaagtacagccataaggataacaggatttccagagtgagaggaaaggaaaaagcagggagaatatttgtaaaaatcatgactccaagcttcccaaatttgttggaagacatgaacctatacatccaagaagttcaacaaagaccaagtagaaaaaaggcaaaaaaaaaaaaatctcattgggacacattataatcaaactgtttaaagaaaaagacaaatggagaatcttgaaagctgcaagagataagtgattaatcacatggaagagatcttccaaagattagcagtctattgtttatcagaaaccatagaagccagaaggcagtgggatggcatatttaaagtgtttaaagaaaaaaaaatgtcaaccaactattttgtatcaggcaaaactattgttctaaaacaaaggagaaattaagacagttccagataaacaaaaactcagagtattcatcacttgcagatttgccctacaagaaaatctaaagggaatctttcaggcagaaaagaaatggcactagacagcaacttggagccatgcaaaaataatgaacaatggtaaaggtagttacatagataagaataaagccaatatttttgtagtttttgtttgtaactcccattttttccctaacttatttaacaaactaatacataaacaataattataattatattgtggaaaattatacagaataatctcattgtgtataatgagaacacaatgagtcaaagtgtgtttttccatgtgtataaaaatttcctttgtcgccgttgtaatttttaacagcacaacttatgtatttcaaatagacacaaaattagtagcatttacagtagtatcttaagataaattgcctttgaatgagatcttgctttcaatactttgatgtccacaaggcatatctagaaaattttatgctttggaagatgaagactgcttaatccaacggggaaggggactatgatttctctttgactagttgccataacactgtccttaaggcatatgaaggacttttatatgttatttagacatcagtaggcacagaagctttgcagtacaactttgacatataaattctgtcattttttttttactttaaaataaattttttttttaaatgtcactttgctagcattgataacgctcttaggtccaccacaacattatatctattcacccatactatttttgttacaaatgttaaaaaggtgatttcttcctgaaaggactgtgcttcaggtccccattcaattttagatgttatatttgttttttataaattttccaagaatgtagtggctgcattcttgggttgctgtcactcttcctttggtttttacacttactgagaagtggctgttgtaatttctgtcatgtgcaatgtattcctggaaaaagggatttcaatatcagcatgttattcttcattctatttcctatgcagttgttggtgggaatgggaagggcctgcccaggccatcattgatgtatactgattacaaggctcttgagtagaaaagagcctgcatcattgctggcctacagccaccagcttcttcaaggacacagagcagattatggactagaggaggaacagtggttgttgtgcttgttactctgtagacccagttaagtttcttgcatagttaaccctccatagatctggtttgctttttaggttaggatgaaaaggcaaagagaaagaccaaattcataaattttggagatttattcctagatataaacttaaaacaagaaaagaaataagaggaattagacaaatgaacagacatataaaagtctagatagtgaaggtaggtccatctcttttgcaacagcccaaacaaatactgttttgacatgacatgcacatgtcattggtgtaagacagaatgacgaattccaagctccagtccttggctttgttaaaaaatgttggccaggctgtgagctcaaatcatatttctttatctagattttaggtcattctattttgaaagaattcttttgaattataggaaatttctttaaaaattggagataacagaatgctatggggatgtatggcctgacatggagaagagctacgtaatgtgaaatgctccttaaattgcaagaatctcactcaaagttttggaatagaatgcttcatgactgattgttgtgtgcaggaaagtggctattagaaataattcctcttactcatacaagagttgccatttgatatcaaacacatgcatgcataaacatcccccacagacattgacttggagcatttgcttctcaaatttttaatttaactaatatgtcagatttttacatttacctgttcacataatacaggtctacatcttgagtacgtctttgattactatcatgattccacaagatggcagtgtgttcttagggaccctgaggaaagctctcaagtgctcgtgtgtgtgtgtgtctgtgtgtgtgtgtgtgtgcttgagagagagagaaggagagaaagagagagaatgggaagggcgataagaggaggggttagtgatataccaggggttgtgaaaataacctcttttttctaattggtaggacagattctttttacgattcctaaagtggaagaaataaagtatctctgctatgttcatttctttttggattgaaaattttaatcctcagtgaaccagggcagaaaagaatgatgatatccttgagagttttactggtgatcctgtggcttcagttaagctgtgagttgggcatctctataggaacataatgtacaatattttgagatattgtctatcctaggctgggggctagaagcctgaattttttctctaactaagagagtagaaagcctgtaaaaacatgatttgaattctggggagtaagcatttacctcccaatttgtcttctctgtctgaccactgtctttttcacaggggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaacacacagtgctccccagacacctgcagtctgtacccaaacctgctgggccccaggaatgcctgatgtagagcttagactgcagggcagtaaagtcctctttgctctctagattcaagtggaaattaagagtactagtatggaggactgattgattagggaagtattattataattctgaaaataattgagaccctgaagaaaaatgaaagatacagtcttggtctggttaaaatattttccagtattctctttctactttagttttaaaatattttttatatttcttctggagagattaaaaaaataaatttttttgagatcattgacaaaccagaaggtttacatattcatttcatacatacatcacaatctatgccataagcatatccatcatctctaaaagtttacttcctccctccttttttaaaaaatttaggtatgattgatatacagcaaggtgcctatatcacataatgtatacattttaatgctcactctagttttatgccacatctatgctttattagatcggttttatgattccttttatttatatcaagaaaacattttcatacaataacagatattctgtctctgtctgtaggacatcttattctttccccatttagttacccaagaagtttgatagacgttgctttaggaatgcaacagaaaaacacaaatgcaaaataaaaaagatcagcaaactactgtgaaaatcctgtaagtcataaattcttttagttatagaaccctcaccccatctccagccttagctgcagctccactcctgagttatataagggcacatttgatgagtagatggcagaactagagggagagggtgagaacacgttaaaaaaaagcctagatatttgcagagattgaagattagagagggtctatattgccattttggggtaaagtctgaattgaactcaaaaccttgtggaagagtatattgatttctatgtaactgagtgtggcttggagatggtagggagtcttagctctagtcacagcatgtcatatacccacagcacctgctggaatgacttaaaatttattgagaaggatctctaagtatctaaaagaagtctagacaccaagaggctttgttgtgatgaacaaagacctgtttaaatcagtgaccagagaccgtatggtattgagcatatttcagcaaatgttggaggagagttggaaacactgaagagcatataaatgcctccctcctctgactacctagcaatacatatttgccctgcaatatatactatgttcgggcaaaatatttgtgcctgatgaaaagaatactttttagtagctattaagttgaattacaggaaaaaactttgaacatcactttattataaaagtgaagttgtagtctgttggacatgatatagtttatgtagtcctcaaagtgggaaagtttagaaatggagagttaagatttctgtcaagggttgttcccatagtcactgatgaaaaggatgaactcaatccaaatttgcttcaaattcttaatctgaagaatgaaagactgaataaatctttccaagccttggaagaaagatttgaaaggcagtaaggaagagcagaaagttgcgccagaatcaagacccttaaattttacttccacatttgttttataccttttggcttcctggcattctggaaagaacctgggttgtgttttctgtttgaatatttatgttactaatggtccatttattaggctacatactatatatatttcaggatttgtttcagtattaaatgagataacatactgctttgggatgagttccttaaaagtagagactgcagttggaatctttctctgtaattgattgaggaaaccaggttgagacagggggaaaggctaagcatggacttggtccagtgggagtcttgatcccacctgacctcatagggagctctggagagtgaactacatcacaggggtgatccctcccacgctgaggcaagggagccagactgctctgacctattgtgggtaagaataaagtcataattggctgcagtgtttcttggggtagaggtatatgctactggacaatggtggctctcattggcagaggtcaactttctagggaaaggggcaaatgtgagccaagagtagccaacactcacagtagcgggggatggctacactgtcctgggaaaggagatctaggctgggggccagcagtgttcgttattaccagggaacttgcctggtatgtgggcagcattcaagaaataataaactttaatcatattctgaattttaatttcactctccttttgaaggtgtttatacagctggccttaccaattttgaggagttgaaataatgtaagttaaagcacttgttaacagaaaccatctaagtaaacataaaaagcagatgaaaggaaaaattttttcaaagctaaaattcagaaatttttaaaagagtagtgaccagagaaccagtctactatcttagttgcttttgggaatgatgagataacattctatccatcactttctatccaggtagcaatgattctgatgatttacagttcataactctgggcttctatgtgtagacagagataccatctatatttatacatgattaatgctattttgttattaatttgtatttaagaatgaaggactgggtagcaggatggactccttatgtctttgtgtccatgttccccacaaagtttcttcttgaatggggtgcctggccagtagtgtgggtatgtgggtctgtcatgtgaattgacaggcttctttctaggatgaatgaggagggaactggtaattaaggtgcttctctttgttccctgaacctaatatcattggaaatggcctaattatattaattactcataataaaaactgaaaccatcccagatggctcaagtaaactctcatgaagattacatgccccaagttggcttcatatgcttctcacacacaaatacagaagcaggttggtgagaacagagagaggctagtgcagccattccacatgtggaccttcactacgttctcttgtgttctgttcctctcacccttcatcacctgctctctttctcagcccagaacctctccagggtcccacccagtaggttcccttcactcacgtttccactgtaatcttctcacagttcattctggcctggactttttccctctctgttttctccatcagtgtatttgcatccactttttatctacctcatgggaattgtgataactttcatctttttattagttttattattgatggattcaggtcattctgtttataattttacatttcatttcagtgggaattttagagagttaagaggacagcaaatatgtttagtttgaagttttgtttcagaaccccaccctagtaacatttaaatttttaagctgactatataattttgtcttacatgtgataaaaaatttataggcagaatcaagaactagatcagaagcccaagggaaaactgatttcaggctggtacaattcaatggagtattcagaaagcagtttttgttctgaccttgtaaaatcccattttacctgagatttttctccttactgggttatttcatttttaggatccaatgatctctatgctacaatagattgggtggggaaggctttttgctcaaaagcttcattttattattggggcacagagcagtctgttcttgttcgctattgtctcccacccacatggcactgctgtttgctttgctctgttgagcgtcaccgtcaatatctctcaccatttctacacctctcacaggttcctctcatttctggtctgctgcttgcactccttccacctgtattgagttcatgtaggtttactttttaaaaatctctttaactattttgataatcacttatttatatgttatattttcttccatttatcattctgttcaagtttctttatagatggagaaacttaattgtggagatagaaaaactgcattaattttttttagtggcagattctcataatttggcacaatatatcagtctattctgaacactgacagttggaatagtactctcactttctctttttaaatataagttatctaaattattttctcctaggttcacaaatattaaacttgttgacctgaaattaggaagtcttttccacactttccacttgacaaagaaaattcttgcctttaatcgtttgctttgattaattaatgatatgtgatccaggctgactttaagtatgagtctctgatctaatttattttttaaagagtcaactaaaggaataatctctttcacccactgtaatgctcacatccagctgcacagggccatatgaagctcagcccagactgagacaactgatcaccacccctcttcttgatgaacgactttactaatatagagtgtctcaatggttttccaaagtctacaacgttgtcttctgtgactaatttctcagggaagtaaattactcttctatttctacataattctcatttctcatgtatttaaaattaaaaccatatactctacggaagatgacgtcatcacagattcgggaagaaagaaacactttctgttggttttgatatcacatctctcaaatgagaaggaaacagttcacttccttggatctgtggttccacctgtgccctccagggggcgacgttgcactaaggaggcatctgtgttcattgccgaccatcctcatccactgagcctcctccctgcagctggctgatgtagctcactgatgtctgtgtagatagggagctgtgacgagagcaagaggtcagaacacatccagactccttaagagaaagcctttctgttttggaaacttttcaaagccagggacttgtccagcccaacctccccattgctcctagctcccgaggctcaggacccctggcttctgtcctccctgctcagggtcctgcagcgttgcctctgctcagccatgctcctgctgctcgtcccagtgctcgaggtgatttttaccctgggtgagtaacattccattctttttcctccttttgtaaatgtgactgtgttgtaattgcctctaagtagacttcttagcgaagtcagcgctgcttttgcttacacagcattggtgttgcaggaggaaccagagcccagtcggtgacccagcttgacagccacgtctctgtctctgaaggaaccccggtgctgctgaggtgcaactactcatcttcttattcaccgtctctcttctggtatgtgcaacaccccaacaaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgttgtgagtgacacagtgcttgagactgcaggagagctgaacacaagcctcctgagatgctgagactttctgtgactcaagaactcgaccttgaagtctgttttataatattaaatagcaattccaagtttctgatgcttattgatgtgtgctgtatctttttcatctatttatttttaaactatctatgactttaaatttaaagtgtgtttcctttaggtagctttatatataaggtctttctatccactatgtcaatctctggttttgcactggctagtttagataattataatttaatgtatattgatgaaattggattttagtatactatgttattattgtgtttctgttcctcccttattttttgttgttctttttttttgctgacactttttggattatttgaacatttttaacactattttaatctatggacttctttggttatatttccatattttttgagtggttgctctggagattataatacatatgactaactctccagggtcttctgtgatgttgtacctctttatgtaaaatgtagaaatttttgtataatatgtctctttattatacaataataattgtctcttcaacaaacactgaagtttgttgtagtcgttcatgtatatcaaagctacctatattggaaagctcaccatataatggtacaatttttgttttaaataattgtatggaccgtataaaactcactaggaataataatatttcgtatttaacagctatttactaactctggtatccttcctttgtttctaaagtaagttttcctctgacaccaggagatgtgtttgaactgatgtcattcccttcaaacttaaaaaactccctttaacattttttctagagtaggtttgctggtaatggtattttttagtcatttgttatctgaagatgtctttattcttaatttgccctttatttgtggaagatatttttactgggtctgtaattctgtgccaaccattttcccccctcactttaaagatactgtttcattgtctgctggtctccatgttctggttagaaatctatggtcattcaagtaattgttccccaatgatattaatatgttgtttttctctagctgcttcatatatatgctatttgtacacacacatacacgcaagtaaaatcatatcatcttttgttgtcctcagtataattatgatgtttacatgtggttccctttaatttgttcctgtttggggcttaaattcataagtttgtctttctttgaatttggtaagtttttggccattcttctttcaaatatgttttctggcgcaatctctttctcttctccttctaggactccattagttacaacttagactttaggacactttcccactagctctccatagctctattttgttttctttcaatttttttcttgattttaaggtctgcctctactcactagatccctgtagcattacataccccatgttgtgacacccaaatttctatctagatttgtcaaatgtctcctgaggggagcaaagtcaaaattagttaggttagataacctatactggtctattttcaagtttgttattcttttctctatcactttcattttgctattgagcccttactgtgacattttgattttggatattgtatttctcagttctaaaatctcctttttttttttttttttttttttttttgagacggagtcttgccctgtcacccaggctggagtgcaatggcatgatctcggctcagtgcaacctccgcttcccgggttcaagccattttcctgtctcagcctcttgagtacctgggattacagttgcgtgccaccacccctgggtttttttttttttttttggtatctttagtacagatggggtttcaacgcgttggccaggctggtcttgaactcttggcctcgtgatgcgcctgcctcggcctcccagagtgctgggattacccatgagccaccatgcctgggctaaattttcccttttttaactttgtggtacataatcaaagagctactttaacgtctttttctattacttctagcattttagtcatcttgacctttcatctgttgatcttttacttaaatattagtccacttttctgatcctttgtatgtccaataattttgaaatgcatattaaacattttaaatattaagggtgtagactctgttttcttcttctccttctcatccttattcttctttacaaagcattcctctgaagaattttgatgcttttgctttagcaggaaatcaacctagtttggttcatactgtaaattttctcttcccttttgtggaatttggtagctcaaaatctcagttcagttctctaatcatttgcaatgttggtttggatttatccaagtcatgtgtagcttagggattagtgtgaaacctgtttgggtggctcaaatatcaggtcagccctgagctctctgctacattggtttttttgtcctgcattggtgccactcaggaggtagtctgagactgaaatagtggttcaaatatcagttgaataacccaagctttgttgatctggtttgagtcagtcccaggtacatggagctttgggattagcctgagacttgagctgttttccatttcttccttggggtctgtcttttctagcctggtccacagaggcagaaagattgtgtctctttctgcacaatcttttggtctcctgcacaatcttccgcacctcttttggtctcctataccattgttattgccaccctaccatacaccaggggcctttctaagggcaaagacaagagagaaaaacaggaaaaaatatgaaataaaaggcttgcacaagttgcttctccaacgtttgattttgtctgctttgagtaatttcagaggccacagatagttatttttttgtgtgttttgttcagttttcacttgtaacctgtaggagagatgggctgtaggcgtcttaaagctgtctcctattttactatgttcctgcattaacttatggtctaccataatatgcatcaagaattgctatttgatattttcttttcccacttttattttttattacttctttcagtcaatcttattcattttttatatatgtacttttttttttgtcattaggattataagaatcatctaattacggtcttgattctttggatcttttttctccaaactcacgaaagtctttctttgatgctagaaaatgagcctgtgcacttgtttttaatatgagcttaaagaactattttccccaaaatataaaatcttctggattctgaacaatatctgaacccaagagcataataaggtgtgatacgactatccaaagactatgcttttccagtacctaaagcagagctattttattttcaattttctgctctctctgtgtttttcatttctgaattttcacttattttaaatggaccatgcattttgtgatttatttatttatttatttatttatttatttttttgagatgaagtcttgctctgtcgctcgggctggagtgtagtggtgcgatctcggctcactgtaacctctgcaccccaggttcaagcaattctcttgcttcagtctccctatactagctgggattacagacatgcactaccacgcccagctaatttttgtatttttagtagagatgggattttgccaagttggtcaggctggtctggaactcctgaccttgggtgatgcacctgcctcggcctcctaaagtgctgggattacaggtgtgagccactgcgtccagcctggaccatgcattttggtattttggggtgtgtttggagactattcaatctccctgacaatcaatgtatttcttcaaatgctgtcaacatcctccgatgagagcattctatttctgatcctattcctcttcaactatgagatgttgcctctaaatcaatagagaattgagaaattcctttgcattcttttagtgcagagcaaaaggcagtattccaaggcatcatacaatcctgtctttttcactttgaacacactgggatttgcaaacacccagcaactttgagagacattaaaatcatcaccagcctgaaagtcagcagaaattgctcctcatagtttattttgactatgtttttcctgccctgactttaaacttcactgtgatcccatctacttttgtcttatggaaacatggataaatctattctttccagatgatctttgtttttactcttttggattttggtttgttctcatttatatttctatttttttagttaggaagaaatttggtagatatgggatgtgagtatatagcattaggaatctaaagtccacactcaaagtctatgtatttacaaaatgtcagccatactctttctacacaaaaaacaatctgtacaggcagtaacaaatgaatcaagaacccaaggagagaactggccacatgctcctggaatcaaagaaaataagtattctgactctgtaaaagattctcattggccacagagaacctgtcgaatttctcctttctcttgttttcagagattgcttgtttggtgttggtgtatttccttcagccctagaggtttctgtagttgcgtttaccttagctctaggggcaaagcctttccatcctgtgttacaccttgtcattagtcatatagaggcactactcccattttaagggtcccgtcttttactctatggccgcacaagcatcttccaagggaaatatctctatcatcctccaccaccaacaaggcaactctgaaccatcaaaaactcatcccgaagcagctagtctgcgtccaacgattctcagaaacacagcttaattctgatatatttttaaaacctgatttctcaatgaggtaacgtattactctatttttacatgacatcttattgctaatggactataggcctaaaacaccgtcatagacttgggcaggaagaaacacatggtgtggatgttttgatacatctcagaaattaggagaaacacactaatgagctctctctgctaaactggttctgcacttggcctccagagggcgatgctgcacacactggagcttttgtttctgttgaagatcaatccactgctcagtttcttcttcctgcagctggttgagttctttccagacaaagacaagtgacaagaattagaggtttaaaaagcaaccagattcatctcagcagcttttgtagttttaaataagcaaggagtttctccagcgaaacttcctcacacctcttggtcttggtctcttcagacactttccttcctgttctctggagatcttgcagaaaagagcctgcagtgtttcccttgttcagccatgctcctggagcttatcccactgctggggatacattttgtcctgagtgagtaaaatttctttatggtctctagttccacaggttctgactagaaatgcttgctttttatactgagtctgcactgctttcactgatagtacattgtttttccaggaactgccagagcccagtcagtgacccagcctgacatccacatcactgtctctgaaggagcctcactggagttgagatgtaactattcctatggggcaacaccttatctcttctggtatgtccagtcccccggccaaggcctccagctgctcctgaagtacttttcaggagacactctggttcaaggcattaaaggctttgaggctgaatttaagaggagtcaatcttccttcaatctgaggaaaccctctgtgcattggagtgatgctgctgagtacttctgtgctgtgggtgccacagtgcctgggtctgcagggggagctgaacacaaactgcctatgctagagaagttttcagagtttcagtatatctccctgtggtgttttcaaagatctccttttttatgatggcgaatgaggcaaagagggctaagccgacccaggcatttctatgtaattctgcagttcctgttatgctccatgtcctgataaattttgtttcagaagctttttgctcattgtagaaactatataataggaaatagtattcttgaatgatggaagagatagtattcttataacaatcaagtcctccatgacttaccttgatgttgtctgcattagggggttgaccatgtgagctgtgacatggcctcagagaaaattggttttcatttataatttcatctgtcatctaatctggaaaatagaagatgattttctcatgtttttaccttgcaaatttgttttcaagttggtcattcataggttattttttttagagtttctttttttgcctctaactgtggtatttatgtgtctaaatattttgtctgagtttaaataactctatttaggaagaactgtgagaagttattagtcaacaataaaagagtcattagaatcatgaaggacttagaaaaatgtcaggtgatgttagttccgacaactatttaagaatagtgcagaagaaaaatgaagattaaaaattcatcagtgtttctccaaatactttttcaccgtgagaaaagtagtttcctattcttttagtctcagaaatgctgcaaatctgtatcagaaatttgtggctataatccctttcatttttcttctagctactggcatttctattcattgctttcgccctgttgttatatgatttcagctattggaatattaaagatggattcttataacattttgataatcaatcatgtgataagtttagcaatgccaaactgtgctggaaacactgataagaattacaatgcatggtagagagtcactggacccagtataaatttatgactttcttttgtctaggatggaaagaactgttgaagaagcttttatacttcttgtttgcttgaagccttggagggtagcaagtagtctggagaaaaaggagaaggaggatgaatctttccagctgctacttggctcacgctataatgtattagagggtaggtacgtaggaaccctcaaatatagagagaataagaaaattgtggccaatggtacacgttagccaaatggtgaaccagcagatcagcagtagtttttaggacctagtgagatgattatatgggatagatgtatttcaatgattgctggatgggtataaggaaggtaaatggaacattatagatgtaaaattatgaataagatatgtactcgtgtaatgtcccctgcctcagtccctccattcttttctatttctaaagcacactgtcttctacctttgataagatggctaacttcaggtgactcactgttatcagctcagccacattgcccacagggactgtgatgggcactttatgcgaatcttaaaggaggtaggaacatagaattgttttgttgttgtatgtgtttcaaatgtatgtagaaagttgtatatagaagtcgaatagtccaaggggtggattgatttattgactctcagctccaaattcaccccttgcctcttccgtgaatgtggatctgtacccttcaactatgttccttgccagttggcataacgttatgctttgccagtagaggatcagggagaaaagattttgatttttgctttctgtgtgcacatgccacaggttcctgcagcatgagaggcttctccagcgtccggctcctgcagtgcacccacaccaggttcctgcgctgtacagtggccagcagtgtcctccagcacttccatttttgcgtggtactgcagaacagagcctgcagtgagacaccttcctgtatccagctttccccatattcatccctagattcatgaatcggcaccctagattatggttttctggtaagtatgagagggtgaatttctctgtagaaaattcacagcacaacagtgacttctgtgtcatctagtgagacacagttgtgcctttcccaataagatctgggtctcacccctggggggtgggtctaggggtcccttcttggggtgttgtacccagccctaggagtagggactgcaccttatatctgctattcctacaggaataggaatagcagagttttcttttctttgtattacctatttccttgttactctaaatcctgttataattaataattttttatattaatattaaattttcctataattataaaaagcattttctgttcaaattattatatggtctatctttcctgattggaccagatttatacatgcaccaaggatctcaagccactgaagagcatctccccacccagtcacctgacaaatctagttgcttgcttgttttatttattgctcatttgttttatttatttatggtttattattttacttatttattgttttacttatatgattacaagaaactttatgcaataaagaattacattaagaagaatttggaaatatgtttttatattaatgaaattaattttgatttttcacattttgtgcatgtttgacacaaaattttattataccattgaggcaaattataattccttttaaatgtattttagcttacaacacaaattgtctttcattcactaatgagactgtgtctgaagattttaaattccaagtcatttttcattcatctaactctgttaattatccttatttttgatttctttaaaatggagggaaaagaccatgataactttaaaacaatctgaagacagaatacttctaacacccagaaagtttttgtgtgtgcctttccagtcaacccaccttctggaggcaacagatgttcatatttctagtattacagagactttaaccgttttaaaacttcgaatcaatgggattattcagtaggaactctcttctgcctggtttctttcactcgtcatgttctggaggttaatccgtgttcattaccgtaattgttgagaagtttcctattatatgaataaagcacaatttatttattcatttggctgtgcacaccattggctgattacagaatcttttagggattaaagctttggtagcattcttttttttttaattagattcaggggttacatgagcaagtttgttacatgggttcactgcgtgatgttgaggtttgggcttctaatgatcttgtagtgaacgtagtaacctatagatagttttgcaacactttaccctccccccatctcctcccttttggaatccccagtgcttattgttctcatctttgtgtccttgtgtactcaatgtttaactcccacttataagtgagaacattgtgtatttggttttctgtttctgtgttaattcccttaggataatggcctccagcttcatccatgttgctgcaaaggacatgatctcatgctttttatggctgtgtagtattttgtggtgtacatttaccacattttcttcatccagtccaccactggttggaatttggtagcattcttggtgcaaggtataggctgtcctagatttttatatgccgttcaggcaatggtagggtgtgtctctgaagttctatagttgaaatccatatcttaaatacttttatttaaaaaccaattcctaaatttcattatgctatttaacatgtcactaatttttctaataaaaacccaatatctgatatttcctgtgctacttataaaagcttcaggtatcattcaagctgtgggtagctgaactgtagtttcctctgttgtggccttacgtgttgataacaacagtagctgaccgccttggagtttgctttcttgactaagtgaattgactctccttagagttgagacttaagttaaccagctcatgcttgatattctgtggtttctgttgaaaagatttaatgtaaattatataacctagcactttagtatatttattcttacttggtaacatatatatatatatatatataaaatgaacaatattttgataagtgttcctgcaaatcctgaagatctataagtcatgtaattataatccttgctcaacagtcattccagagaactcatttaatatttagaggcattttgctatatacagtacatatgaaaatattttaaagcttgttaggtaacttataaaggaaatttcgctgttatttaatatcacatatgcagcacatccaatacaaatttccaatcgtttaagcacaataataaagttgtcaagataattagaggtctgtacagaattctcatggggatatctaagacaagggagcacttttattcaggaaacaagtgcaccaaaacatgagtgtaaaaggtagaatgttaagatgctgaagatactttatatgtatatttatgacttcaagttgctctgtgtgatatatttcatataactggatattaaaaatttaccttcacattaattttctagagctgccatgacaaataccacagacggggtggcataagcaacagaatctgtttttctctcaattctggagatagaaatccaagattaaggcattggcagggcaggttgttattgaggcttgcagatggttgccttctcaccgtgccttcaggtggtctctcctctcatggtgcacatgtctgtatctggatttcctttcttacaagaacaccaattatgttgagttagagcccagctatataacctcattttaccttaatgacctctttaaagatcctgttttcaaatacagtttcattctgatgtactggggataagggcttcaacatgtaaattttggatgagacacggtttattctgtggcaaccctccagggaaataaatatcaaattaatgaagaagacaattaaagcctctcttgacacaacactttgctaattgctggcgcacacaatgatcatatataattttgatgatgaattttccctgctttcttttgtgattctagagcaattagaaatgtgcaataacagatgcagatacttcctaaatatttcaaattgtaaaggaagtagagagtacaatgataaaaatgtaaaagctattatttagacttgccttctttctctctgctacattaggatatggaattttctcatgttaggtttgtccttttctgcagctaaatcttaatttctttttggttttccatctcagatagttttcctttctttctctactcttttctgtatgaatgttgagttttttaccttgtcttttttttcctctctcttgtctctgatctcaactttgccagagctattttagcagactaacttgctattcttatcttgcactactcttttactacctaatcagcagaagtgacatttaaaagaagcgaaaaggattgaaattcttttggaagttgtttatggcaggtgcagtgggttaagtagatgagggaggggtgctatagtccttgaatacagaggcagcaggaagaatcccatcctatatgctcagctttcttggggcttgttgtctgttttttcaagcagtatgtggcaagatttttaattttgattgaatcatagtctttttaaaaatatgtttcgattactgatacatttggattcattttaacgttttggctctgctcagcatgctcttgatttgttctttcgtgttttagtctgtcttctgttgcagtgatagttttcttttttctttctattgttttagaaagtgtaaattgtattttttgttcctaaaagtatccttatattatatatgtatacatatatataatttttaaatacccaaagttgttattattttttcctgaagttattccgtaacattttttccttgtatgtccccctctttctccttgggtatatttttttctccttttgacttactgtctttagaattacttctgtagctaattggaagaaactatacacatactatatatatgaagacagtaattttagagtttatcaaattagccaataaactagagctccaatgcacactaacaaaagtaataaaaaagaaaaccattcaacacaataatgggaacatgaattcattcccttcttcctcagagcctttgcccgatcttccctctgcccggagtgcttttcactactagccacactgatggttctttcactagttcctagtctctgctcctgaagaaacatgagcacatgtgaataaaaagaggaattctttaaaagctttattgccattttacattttatggttaaaaaacaacattttaagtgttgatcaataggagaaaggctgtataaactgaagtatatccctaatatgatgcagtatagcagaaggccccatatgaattaatacaataagacctaaagatttattattgagtttataaagtgagttacaaaaaggtatgcacaagatgtatcatttttattacgttttaaacctataaatgaaatgccgtatatttcagctgtttcatatattttgtatatggatgtagatagagcatcaactccaaattgattagatgaaacaataaaggtaataagggatgaacggactagaactgggagtagtggtcgaaggagattttagtctatctggaatgctgtattactttaaattatttcatatatttgtgaattctttctagtattaaaccaaaaaaagtcataaaagccatcacaaaggtttatctacattttttccttgtctactcatagaaaaagggagagaggagaaaacgatcaccttcttcattagcttttgttcagccttcctacgtattttttttctgcctctgggatcatacagcttctagtttacactcctcttaggttcctactatgtgatttatattatagatatgtatttttgtccactccagtagaccataaaactaatattacatctgcttttaagtattcttaaaacctaataaattattcacttagagtaaaactttaatacatgtttttggacttactttgaactaaattaaaggaattaagtgaagagtacaaaaagagaattgccaaattaagatactgatttccacgaaatgacattttaaagtggtaattggttcattcttaatccccatccaatctaggcagttgtattgttttctgaccacctccatttccttcataggaaacagtaaatggggctgtgtgtgtgactactgaggaattagttggtccgtagtggtttttgttgatgggttcagtccactagggggcactctaggatttccagaaatgaagactttttctgatggtcccaaagggtggaacaattaaaagagaagacaagggggcatgtgagtcagtcaagtcacagataacaaggaattgcagtggaatggggggcagtgtgtgtgtaaagttcatcttcggttttcagctctgacattctatatagaacctcagaaagctggagttcataggtctacgaatccattgtgaggatgattctataagcagaggtaagggaattggagttttactgggaattgggaggatggacactcaatagaaaacatctctattacatattttcagtttttaaatttttatgactaaaattcctgaaattcactggcatggaaattattccaaaatacccctgatatctgatttcttcatatatcttctctgagaccaaaaggaacaagaataagcagaaaagaagaaaataggaaggaaataaggaccaaaaccagaaagagaatagagaggagaatatttaatttggccagcagtatgtggtctgatcgtaacagctgtgtgggcctgcagggtgtgtagggaaagggttggacagagtgggagaggtagaaattaaatcagggtggatatcatacacacatcctatttttcttttaaccaaacaaactctagttggaaacattttctatgcagacaatctcctgatttcaagaaattgtatttatttctaaatccaccatacatgctaccagaaagttttccttattaaaattttcatataattgaattttgcaattttctgtccagctatgtaatttgggcttcccatgattctttaaggctctactttccccagctgagacacggattcttctcagacgtatcatcctctttcttcacatactattctacaatttctcttatataaagtactttaaggaaaaaaaaaccctgtaacttcatacactggaaatattgactcttccccccttgcactattcacacccagagttttggagagattactgtgcggtctcaaaggccactgctggtggagtttcctattcagatgaatgacagagctcaggtgtgattggtgctcagggagtctggtgcaaactattgactgtaagaacaagtttgtctggacccaagacttgaccccttccagagcagcggcaaaggcaccccagcaaccaggcaaggagccatggagaggagactgggagctctcttggggcttttgtgggtccaggtttgctatgagttgggccgtcctagatgggggctgacaggggaagggagggaagggagagctgacacaaatctcctggactgtcctacagcctcataagtgtttctagggatattttacaggcttggaaactgcatcagtgattccttagtgacataatacatatttgcttttctctttccaagcaggggtgagacgagtgaaggtggagcagagtccttcagttccgagtctccaggagagaaccagctctactctgagatgcagtttttctacctctgtgaacaacgtgcagtggttccaacagaatcctgggttggcctcatcaatctgtttttcatggcttcatggatgaagcacagtggaaagttatggtcaaaaagaaactctgaggagctctgtggtaccctacacatcacagccgcccaactgaaagactcaggcacgtacttctgtgcagttgaggcacagttctcccaggaaatctgcagcctggatccgaactgcagctgggcctgcagccccaaccccttccgtgagagaggcatgttgcccccacagtatcacttgcacagcttcgggttttctgattgacgttgcgcttttatctctgctaaaattagacacttcaggattgccatttaacttttttatcctacccttttgctctcagaaatctctttgcaggaaaaagctttgatatggaaccactggagcaacttttaaagatatcaggacccaatgtactgttaaaacagatcctctagcaaagagcatataaattacatataaattactgtgataaaaaagatttgaaaaaatatatcctggtcaagaaatagcaaagagcatataaattacatataaattactgtgataaaaaagatttgaaaaaatatatcctggtcaagaaatagcaaagagatgactcaatgtttcatccaaatgcatgttgttcacttttctagtaaaagggaagagagcatgtgtgatgtatattatatataattttttactcctggaacccataaaagataaaattttaaagcacgtaacgtcattggatgtcagacattctctgaatttacatatattatctgggtgctgacaatacctctttactctacacatgaataaactgaggattatagggcacacatgtcttgcctgagctcagatggttatgaaactagcaatgaagctgggctgggattctccttctcgatgtttgaaagcagagtgtgtactctaagctacacacaatagaagacccttgagaatcacaaaataccaattatttcaattgataaatttgtgcaatgtgctcacatacatcactggcaaatatatccgttgggataatttctaaattgcatctagtaagaaagagttcattaaacttttcattttgttacattaaaatccatttgtcttccttgcattactcatgattttgtaacatcattcaaggtctcgaaaagagaacagaaacttctagggttgccccccaaaacttacctgctgtagccgcagtccaagacttctgagaagcaaagccaaagtttaaacctaaatgtggatcagttacaacacatgtagaatttcagccttacaaggtctgttatatgaatgtaagagaatggactaggaaggactggggccctgagaaccaagatgaagacaagctggcagtctccggtgaagctgggagcagggccagcttcctgggtatgtgatctgttgcagcccacaggaccctagttaatgctctgctatcactgccttgacatttttaatagttttgtttttaaacttgtgtgagtaaatgaagttcaatgagaggacagagcatgtaggtgagcagaggagatacacaggacagcaggacacaggacagaatcatatgcaggctcaggttcatgggcacagtgggcagcatgtgagccgagcagttggatgggctattttgagtgcatgagcacacagggctctctggtgttttgcggctctccaaagtgagtggcagtaaacttttcagtaaattattacacaataaaagcatatacatggacaaggcaataaggtatattggagagttattagaatccttcaaaaagtttagagactgtggttttgaaagttgatataacattacaatttggatatctgctggtttagaaatagaaattacatgtaaggatagcagcttaatggaaaagagcatcattttctcaccttttaatgctatcttcttttgtttttttccttaacatcttttttttcaacttttattttagaattgggggttcatttgcaggtttgttacaatagtatattatgtgatgctagagtttggagttataatgaatccattacccaggtagggagcatagtactgaaaaggtgatttttttcaatctttaaccccctccctctgtcccctctcttgtattctccagggtctactgttctcatttctatgaccttgtgtgcctaatgtttagcccctacttataagtgagggcatgtcatatttggctttatgtttcagtgctagttcacttagttatcctaagttatcctaatggtttccagccacatccatggctgcatagtagtccatgttgtatatgtaccgtgttttccttatcaaatccactgctgatgggcacctgggttgattccatgtctttgctattgtgaatagtgctgtgatgaacatatgggcacacatgtcttttggtaggatggttcattatcctttgggtatgtagccagtagtgggattgctgggtggaatggtagttgaactctcagttctttgagaaatctccaaactgctctctatagttgctgaactgatttacattcccagcaacagtgtataagtgttgccttttctccacagcttcatcaacatctgctattttttttggctttttaacaaaagccaaacattgtggttttggtttgcatttctatgatgattagtgatgagcattttttttcatgtttccacttgtatgctttttttttttttttgagaagtatctgaagagcattattttcatgtgaagttttgaacagccacgttttaacatagaggataatattgaaattaattaactttttttttttttttgagacggagtctcactctgtcgcccaggctggagtgcagtggtgcgatctcagctgactgcaacctccgcctcctgggttcaagtgattctcctgcctcagcctcctgagtagctgggattacaggcccctgccaccatgcctggctaattttagtagagatggggtttcaccaagttggccaggctggtctcgaactcctgacccgtgatccgcctgcttcagcctcccaaagtgctgggattacaggcgtgacccaccgtgcctggcctgaaattaattttttaataattgaagatacagtgataaaattaataaacaaggattttgaattatatctatatcattaagccatttctagtttcttatacagcttccacaagttactaaaaatttcagaggaaacattaaaacagcactgtgtaaatttacattgaaaactgagttcagacgtacataaaactgatttgtggtaagaaataaattgttttagaaaaattgtttcacagggaccatcaaccactgatttactaaaatttatatttcagttaatccatcagataagtatgctaatgttgtcacagtatataaaatacttttaagagctccagtatcagttgcatcagcagaaatatccttctcgcagttagaaatgaaaaattctagttaagattttgcatttaataagagcacttgatattgctttcatttatatgcttgaaaatgaagttgctccaggcatgaattttgctaacctcataaattaatttgcagcaaagtgatccataaaattttattaatcaagatatcatattaaagtattattatattaatttatgacaccaaatttttaaaccaattttatgttttttcttatgtatcattataaaccctattgcattttataagtaataaaatattttaagaaaaaaactttacagtttattacctaatggctatttttcctgccttttgaataagaaatcctaaattttcgttttgcactgagtcccacaaattgtacagccagcccagctgggaatcttgaatccccaaactaaattttgaaggagagattttgaagtctgaaagcaatcaggatgtttgagaaagtgccttttgctttacatattagtaaactcctatacttcttccatgttctccaagttgctgaggtgtgtgtgtgtgtgtgtgtgtttcctttaagacagacatgatacgctataaagataagaaatcgatatccagaagggagaatcctgcctccctatagcccagccatggtgtccaccctcatatcactgcttgtgatggcctttatacttagcgagtaaagtctcatttgatttcattttactatggatttaggcttccgttgatctaccatctatcactaatgttgtaggaggaatgaaaactcacataggaactcatctggaggaccttgtcttttcttctgaaggggcccaaggattggttagggtaacctcagacccactagattgcatattgatgtgaaaatggttttggggttccatgatgcaagacaatttctccttgcattcccatactttacactgtacacaactagtccttaataaatatttgctctgttaaatagaataaaataattttacagctagaaaagcacttagaaatcttttagtccaatttcactttacaaagagagaaaccatatccaagatgccagtatggaaccattagatgagccgggagtagaaagaaactggatttcctcccttcctccttcgtattgtttcctctgcctcattcctgcaggaccacattgctgagcaaagagaaactgaggaaaatccagccactttgacctctgcagtttgggtctgggaaagacttggtccaatcagtttgaccatgagaatggagagttccaacttgtgtaagtaaacatttgccactttgggccacagagatactcatgaggctgagccattgttattctaccagcaaatcagtccatgactcactggcttctgtaggagtgagccaaaagtgatggtgccatcctcaacccctggatgtatttctgagaattttcctaaaaatagcaagatgtgtaccttatggtgggtggatattccttgaaagaaggatgtgaacataaggagcatcactctacattgtttaaaaatgatcactgaaattgggaagctaaggggaacattgcccctgtgtagctggcagttcatgaaagtgctggaaaagcttttccgggccaaccctttgataatgagtctggcaaaaaacgaaataatcaccaggctgggaattttgtccagggcacggctatattcaaggtacagttaatatacggaacgctgtgctccatgtgagtggtcatattcagaccattacattcagttctggatgtcgtaactcaaaaggacaaatattaacctatgtatctgtctccaagaagaaagtaatttgctcaatgaaggatttgataattgtatgaggaatgggtgagataactgaagatccttagaatggagaaatttcatatatgtaaaagcacacattatatatatacatatatttatgtattgagttgagattcttaatcatagctgtctgtaaatatttaagggtgtgagatgtgaataaataattagatttagtctctataactccagcagactagtgagtacaaatcacaggaaaggggctttcctcctggaaatgagaaagtcttggtttcccaggtaccatttctcatgatcagtattttactgtcagttttctatttgtactattctgctaacaggcacaggaaatatttagccttccattaatttattcttacagaagtaattttaaaatttcaaaagttaaagtagattagaaagttttttttttttttggcagaaacagataaacctggaaacatacaggactgaaggactttctcaatatcttggagaaaaacattatggtggagtttgggagaaaaatgatagatatggaatctgtgccagcaatggctgagacaacagcagttcatgacagaagagttgactcatactttagaggaaattccactaaagatatgagtcagtcactgtgtttaagcacatatcatattgatatcatccactttgatatcaaaaaataaaattatctcaataataaagttacatatgcttacattttttgaatctgcagcctgatgttttctgagaatttcttcttgttttttcaacactttgcagaaagcaagccacatagccataggaaaagacttcttaaaacatgccagatttctccttgcaaaccagcccagtctatgggtcaaactattcctattgttggagtattaataactcatggaacttgtccccctcctcctttatcattgtactttaattctttaccttttattaaagccatctttactgaagaaatattcaacattttgattgtcggtaccgtcaattctctgggaatagcaaggtcatggcccaggcttgagaagcagaacctgagataatacgcactcgaaatattgagtggtcctctctctcttgctctgatctttggcttacatattgcctaaagaaagagttttcttcataacaaacgagtcatgatagtagacttaacctaaaaggaaggcattattttttcttgtttatgagagcgaattatggtattttcttaatttcaaacataaactcagcccatcattgaataaatatcaacagcatctacttctttataatttatgaataatgactcagtagtgtgcataattatagagttagatctctacattcttactgtgcatttaatctctgattgaacacccagtctgtttgactcattgctgcttttgtgcacctgagtgcctcatagggttagagaaaaacattcaaccagcaagttcagtagttagggatgtggccacaagatggcagtgctcctctgctgaggcagaatacagggttcactttagtgtgtcctgaatgaataggtttatggtagcagcagagcctttttcttattggttggctacacagtgtgagaaacccctatggctgccagaggagagaagagacaacctgatgatagaagtaactcttataactggaggttgcaggtcaatgactgatcttaattgggaagaacaaggatgacatccattcgagctgtatttatattcctgtggctgcagctggactgtgagttgagggtatttgggtaacagagtatattagtgaatattcttcagcagttcaaagaggagacttgctttattcaggtttcctctcgttactatgaaaaataattctagagagtaatgacctaacaatccctcttctttctctgattttttctttctgcatagtggtgaatggagagaatgtggagcagcatccttcaaccctgagtgtccaggagggagacagcgctgttatcaagtgtacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagtacacattgcttcccaggcacctgctacccgtacacaaacctgagactggagctgaagctgcaccccctttcctttgtcatagatcgtcaattatagcatttgtcatattgtttgtttgcaagttgaaactaacatattgacatttaaagcatataataaaaaggttaggttcaatgtttttgtatttttagtagagactgggtttcacatgctcagctaattttttctatttttagtagagatggggtttcaccatgttggctaggatggtcttgatctcctgacctcgtgatcctcccgcctcggcccccgaaagtgctgggattacaggcctaagccactgcgcccagcctaatttttgtatttttagtagagacgggatttcactatgttagccaggctggtctcaaactcctgacctcaagtgatccacccgcctcggcctcccaaaatgctgggattacaggcgcgagccaccgcaaccggccctatcttacacattctattagtagattacaacaggactttggaccaatggttaatttacagacagcttgctaaaaatctccctgcctcattttcatgttttgactgaattaaacattactaccacaatttcttttaaaagagttatatcttttagtgttgtagataaatcagtggaaataaagaaggtgcataaataattaattccctatttctcccacctgtggtcaagagtaggctaatttcaagatctcttgtattcttcctaaggatggatctaatcagcagttggaatgggagaacaattcctcctggctgagttttggctgttatggcttgttcttatagggaaagtagttagattaaattagggttaaaacagctggacaagaaaggtcagctgttccttgtctcttccggctctgagggctgcctgcatttcttggcttgtggctccatcactctgatctctgcctctatggttgcactgcttctcttcttctgtcatctccctctgcctccctattataagcacacacgtgattatatttaaggcccatataacataggataacttctcatcccaagatccttaacttaatcatatctgcagtgtcttttttcccttggctatataagataactttcatggattccagggactggggcctaacttttttggagcccttattttgcctaccacagttggcatgcctggtgctatctttttcagaagttgagaaagaaaatcagagttccagatagaaaaatagaaaccacatcaattgctttattttattttctcagtttttacaattttcagtttttaaattatcacttaaaaaggaacacattttgatatgcagttcaatgtgtgaaatttgaattttgatatattgcatagtttgatgtaaccattacataactatgatacgaaacagattgctcatcccaaaaactcccttgtgtgatctgtgtgaaatcacacctccatctcaaactccttgcaaaccttggtctgttcttttatatttttatttttttctggaggtcacatgggtggaattatacaatatataatcttttgaaaagtctgaatcttggttacagaaagcacacaccattgggcacatacatgatcatcatctctgctaccactcttttttttctatacctgaatgttttaaacttttgtcattttacaggaataactcaacatttcaaatgtttgaatttctttggaggtttgatttacagtttaaagaaacactatggcaagtatagtgtttaaggaaacggtatggcaattgataatggagaggttcagttgaggattgaaccaactcctagaatcagagttaaacacatcaagtttagttgtaccaacactaccctaaatttttatcaatagatatttctctaacattttaaggctaagtgtattgaccgaaatgtattttagtcatattaattgggtatggttaatacttggattttcccaggagttagcatagaatgacatatctcacaattatttaaattttttgcactagctgtggctttgtagaggtgaaaagtgttaggatggttattacctcaagtaaagcctgtacctaagcaaattgttttattaacaaaataacaaagtggaaaaaaattacaaatatatgcaacgttgtaccattagagttgaaaaataccaccaaatggatgaaaaagaaaagaatgcaaagatagtataacaaccactggttccagtcatctagataatactgttcgattatacttgcatggagctgtctactttatccacttatacatgtgtttcaaggacctcgagtctgcactcattttctgaaaagcccctaaatagtctctgaagaaattcagtttaatatctgtaatatgaataacttctcaattcttgccatttaaggatggataatgtcaaactaattggtacaaagtaaccacagatcaattcctcgtactttaactgttgaactggtaataaacagtacctaataaggtcattttcacaaggttgaaaggcagtctttctctggaatttttttccaaataccaactcatccaggcttaggtcatgtaaaggctgattaaatgaaaggccaggaaagaaaactgtacctgttggtataaggactgagtataatgggtttatttatctagataagtttgtgaaagaatgaactatataggattccagatactaggagtaatatggacctacaagtcaccagttgatagtaagacaacctatgatggcagagtgaacaactcagggccatgaaagtgaagggtaataatatattagatcatggaaattcaaggatgtctgataccgtaattaattttagttttaatatttctcatgtgttgtgtcttcatttatagaggataaggaggtgataagaaaagagaagttctgagtgagggcaaagcattatataacttcccggaaaattgtgttcccctatatatagataatttgaagtgtcacatattcaactgtttccttaggacagtattccagttcatattccatttttacacttttcatggaatcttataggtttcaaaaaaggcatgaacttgccactttctgtgttctcctagaaaagttttccccaactatttgtataatattgcagccagtacatccctactgtgatgggctgtctctggaaggttgctaaaacaagtattcactggagatcatttggtcccaccaggcagcctttctggccttgatatatcttatcctcactgatcaaacaaatcaataattgatccaagatgtagttactaaaattttccatagatttttctgcatgttctgtaagaggtacttgcatgaggacgttagtcagaaaggcatgtttagcatgattctctgctcatgtatttcttcctggcttctatagtgtctttcctactttggaactttgtctttctttgagtagtatcaataattcaaataattttcgtatttggtgtctattttatagcgatacatgagatgtatgaaaaggttaagaaggttaagaaatctcatcatctccatagtatttgagagttgtgaactatgttaaaacatataggctatcactgtatatatttttcataattggacatagcaaagagagagccacaaattcagttactttaatttgttttgcttcttctaaggaattagattttataatggagtctggagcagtaaatgcattataaaccttgtgttatttcttttcagttttgaagataagacattaaaaacaaaattaattcagaattaggtatgagactgtccaaaatatctgttctgggatggacacttcttgagttacagaaatgcaatcataagattcattgattgagaagtgtaatggagttagacgctatgaggagaaattaataatattgtatagttagtccaccaactggtaaaaaaatggttgtttttacagagtagatcatttgtgctgtatgtggcatcataagatttaatggtgatttcagtgaaagatctggagatgcttcaacaaatttagacatagctgaaatcattttaagacaaggaggataggttgtaatcattatattaagaaataggctataataggcaatgggtctttgttgtttttaatgtaattgagtaatatccctaggacatggccttactgctaatattcacaaaacgaaagccttatcacaatcaattttcctataatagtttttccttgggagacgtatggagacacctaggattcatacctttcagcagtggatgtacagaatgtaatggcttgttatggctcatttggggtcccagatgacataataaaaatgcataaattcaaaggtttgataacttaatgatcagagtctggtgtctaatatggcctgtataaacagagctgggctgtctaaactaacttgaaaaaagaagaaaacttttaagataggactcaatgtctgagggcttcattctaaactctcagaaaaaagagattagtttttttctgcgtagaaaagagaaagagagattagtttttttctaccgtttgttccccagataagcaactggacagactttgggaataggacaaatattgctatattaacatgtaggtccgatgatctgcagtgattagtgcaaacagcttttccttcttagcataatgtgattaatttctaccttaggagaaacaacaacatacatagatgtgaggatacataattgttacatcttccgttgccttcattattcattacatgtagtattttaaagtaagtgccaacctctcaacctcattgctcagttccatcacagatgcaatgactgaacatagcaattggccgaattatcaatttcccttctaacctgaccatgtttattttcatatttaagttatttattatcaaattaagggtgggtaagtgcaaaggaagtttgcattgggtgaggttcttagccagtacatagagaagtgttagataacacaaactagcttgctacaccggaaaacctccgtttcctattccagggcagcagcagcagcagcagcacatagtccagtaattcttctcttacttcatcagactcacctcacaatgcagagccctgaattttaagaagaacaaaatatattctctctagagaaagaaccaaacatgttgctctccagctgcctgagggtggtcacagcttcaatgtggctaggtagggatgcccctggtgggaatggtcttcctctaagacccaaggactgggaaatgtctcatcaaaactttgggacagaagaagtaacagggtgtaaaaatagaatttctttgttccacatcactcatccctaaaccttttggttctttgttttctccttcagaatctggttttgctgagaagtaactcaaattaaaccatcagtattggtgcatgagaaggaggctgtgactctggactgcaattatgacaccagtgctggaagttatagtcctttctggcacaagtagcccaggagtggggagatgattttccttattcatcaggactcacgatcagcaataagcaataggtcactactcattgcatttgcagaaggcaagcaaatccatcaacttgtcatctccacttcacaactggagaactcagtgatgtgtttctgtgcactgaaagaggctacagtgagagaactgttggagtgaggtacacaaaatccccaagggtctgcttgagacatccacttgctggagagaccaaagaaaggattcaccatcacagacaggaagtggctatggttgtgacagcacaggtgtagcatcgggggaaaacactgtaagaaaatacctctctaggcttatagaccatttccagaattatcattcatcaaaaacatcctaatccctgagtctttggtttgaagttagacacaccaaaattttgaccaatgattgagagaaagaactgccacaataagcaatttgccatctggccactagattgagctggaagaattggctaaggtaattcagaaacatatgactgaaagatgaataaaaacaaattcaacactctttgtgaattgttggattttcagatcagtttattcaataaatgctaggtgtcttcaaaaagtttatggaaaaaagaaattgcgtattatgaaaaacggtgcatggatttcaaattttctggcaccaaaataaacttatactaagttgttataacatatctgaacaggatttagtttgaggcactaagaaggataagacatcagtttgaaaggagcccctatcagagcaacatgaattctgttaaacttgaggcaagaacaaacatcaaatttatggtgaaacttgggtggaagaatggtgaaatcactgatgctttatgaaaaatttataggctcaacactccaataaaatcagccatcctcttgtctgtctgttcttaaacaaaatggataatttgtttaagaatagacaagaggatgccgatgaagcccacagtggcagacattccataacaatttgtgaagaaaaaattaaccataagtgccctaatcaaaaaggacggatgattaacagtggaaacaatagccaacactataaatgtctcaactggtttagctcacacaattctgactgaaaagttcaagttgagcaaactttgtacttgatgggtgccaaaaccactatgctcagatcagctccagaaaagagcagagctttcaatgaaattttgaataagtgggataatgatcttgaaccatttcttcaaataattggaacaggagatgaaacatggctttatccttttgattctgaagataaagcacaatcaaagcaatgattagcaagaggtggaggtccagtcaaagcaaaagtggcccagtcaagagcaaaagtcatggcaacagttttttgcgatgctcaaggcattttgtttattgagtttctggagggccaaagaatgacagcatctgcttattataagaatgtttagagaaagttagccagagctttagcagaaaaatgcctgggaaatcttcaccagagaatccctttccaccacgacaatgctccaacttattcctctcatcaagcgaggagaatttaggtttctgtgggaaatcattaggcatccccctcacagtgctgatttggctccttctgacttctttttgtttcttaatcttaagaacgtctttaaagggcaccacttttcttcagttaataatgtaaaaaagactgcattgacttggttaaattggtggctaatcatccagtaagtaagcaagaagaatacatattcaccgagaataaatatgtatcccctatgtgtacaacgtactgtattaggacctttgactataccgacagtagtataaaatgttactcttaagcagaatgaacttaccagaaaaatcttgcaaatcaattgaggaataagatgaaatgcatgaaaacttaaccaatagataaaattccaagtatgtgggcaattaagttttaggggtatttttaggagaatagtgtggcaccgaaaagacacaagtaagcatcatggagagatagaaaacttaggcattaaacgacagacacacattgaattcattcattatacacttacttatgaaacacacaataagcaacaattgtttttgtaggtatgaagagtagaataatgaataaaacagacacatgcagacaacaaagaccttccctcatgaggtttagatctacaattgtctatagtgttcccttcttttacaggaatatccaatataggtatttccaatatatctgtttcactataggcatttgtcttgcctattctagtgattggcaggttccatgtgaccattacaaggcatagtcactgaagtactattaatatacctgtcatttactaaattatttgaccattgacaaaattacttaaactcaggccacctagacatcatcaattgtaataacaataacaatcacctctccacatagttgtaaggattgaattaaatttcatgaatttaattaaatgattgaattgtagtggtagggaacaatttctcaccaatggtagctatacttggatataaatgagatattgcaacaaagacaatttgaaataaaataacaagaaaatttaaggatagataaggcttaaccctctactctcctgctattggttatattattatattttactatatttaggactgagagtcactatttcacactggcctgattccatccaattatttgaactatttctttatctcataggccttacgggtagagaatgaagctttcttgcttcaggtataacttagtgtaaattctatgatggattcacatgagcgttatggagcaggagtcagatatacaccattttatactgagctacagtgccaataactagatccataactgggagcttatttaacagagctctgctctgggagaaaataacttttctaggtcatccttgggggaggaatcctttttagttattcaatttacaacttgtacatacatggtagatgcccaggaagtattacagaagaaaaaaggaaagagaaaaatctaagggacaaatgctagatgcagctgactgagaatcagcacctggttctgccagggtcctttcccatgctacctcttcagagatcagagacagctgtgcgatctgtgcatgggggagtaaatcttgtttctggctggatggggagactctcagcttcctgcaacaaaactatgaatattcactcagagaaacaagagatttggcttggtagtgtttgagggctcccaggccccagccagagtcctccgtgagtctgagggataaaaatgaagaaggctttgggagtttcattcttgattttctcttgggagctgtgctgtgagttgctgggctctggaaatatgaaaaagagcgagtgtagtatcttatttaaaagtctggaagttatagaagggtggttaaggcctcagtgctcacctgtgggggctgtgaaaagagagcatatcttctaaaagctgtcagccatgaatgaatgtcatctgtctgtgcttctctgtttaaacaggggtgaacagactacatacgccggagcagagtccttcattcctgagtatccaggagggaatgcatgccattcttaactgtttatgtgtagggggaactttctttataacctctgtctccaaacagaagtgaagaataatgcaccatctctcatatgtgaagaagctgaatttatatggaattatgtttccttttgtcattattgaaatttcattcctcaatgtagaccatacagatcctgggcctgcttgcccagagtccttccactcctttactgtttgctctgagaggtcacagtctctgagtccatggagcaaagtttcccctggttgtacacttagcagcatttaacttatattttcataatctttaaatgatgtttgctgtatctgtgtatcatctactccataatttacttaatttaacattaaattgatttctctattaaatagatgccaaaaatatgtaaaatattgtccttactttaatagatactatcagtgggaccacatatatgttataaaatgtgcatttgatgtgcaagatattttttcctaatacaaattaaaataatgttacatatataacagtcagaaagaccatctgtgttctgcctaatatgacctcctgtatcaatcgcactttagaaaatacatttccagctcatgcccctcatttgatagatgaaaaaaagcaggctccacaggcatggcttcactttactcaaagcatgtgttgcagtgaaatggaagcctggagtagaagccaggcattctggccccttgtcagttgctttttccatgaaagatgaaaagcgggattcggtgtttgagaaaaggagttgtgtgttgtaattttgaactaaattacatttttattacttatatgtatatataaagatataaaatgatatataaagacataaaacacccagaaaaatagaacacacctataatttcataatcaagaaattataactattatcctgtaaaaaattttggtatacatatgtagctattttttctataaaagtggtttgcaatatatccagtatttattaccatgcttgtttttctcaacattatgtttaggtgttttcatcccaggaagcttatattgaaggcacagttttattttattttcttttattttcaacctttattttagattcagggggtagtacatgtgcagatttgttacctgagcatattgcatgatgctgaggtttggtgtataaatgatcccatcacccaggtactgagcataataccaacagttattttctcagtccttgccccttttctccttccccctctagtaatgctcagtatctacatgtagtctttatgtccatgtgcactcaatgtttagctcccacgtatcaatgagaatatatggtatttggctttctgtttctgcattgatttgcttaggaaaatgatctctagctgcatccatgctgttgcaaaggatatgatttcattcctttttatggctgcatagtattccacggtatttatgtgtcacattttctttatccaatccacttttgatgtgcacccagagggcataattttaagtgattgcctagtttccattatatagatatattttaaaaaatttatcacttttggtattatttcctcttatacagtgttatagataatgcttcttaaaaacataattaaatttgtaattttaatggaaatagagttgcttgaataagggagaacatataacactaaatgcctaatgttcctgaagatatatttcaccaaagtgtaatttcaacagcagcacatggtgatgctgatttttcaatactttatcaattatgaccattattatcttaaagtagcttccattttattaataaacactttagcaatgttttagttttcttttaaagtgtgagtttatatattttattattaaaaatgtgatttaaaaacagagtccatcacatagaatattctttcatacaataagattttttaaaaggtttgaagaatactgttctggcccacattaccttctattaggctggtgcaaatgtaattgtggctttgccattactttcaatggcaaaaaccgcgattatttttgcaccaacctactaactggtctctttttcctcaaggcaatctattctccatgcttttgctactcagagtcggggccagcactgtctggacttgtgcagatgctcagcctccacccaaggctgactgaatttgaatctgcatttcgttaacattcccaggtgattctatcacttcaaagtttgagaagcacccatctgatgggttcccagaacgattttttaaagtataaataaagagatgtctctaattggcaaacatgcttcaatggctttctattgctcctggaataaaatgcaaatttaggctgtggcatacaaagatctgtatcattcaaacctcccctgtcccttcagctttaaactcttttttcctggctttctatgcagcaaaaacactgacctcctttcagatttctgaacttgccatgtcctttccacatttagtctaactctctcaatcatctgcagtgctcttaccctaaatcttggtgagcctgactcattttcattcctcaggtctcagctcaaataccactgctatagagaaaacctgctgacttctgctgatcatcctgactaatgtggccatcatggcttttcccctaactctattacaacacccttgttatatttcattacggtaataatcataatgtgcagttatattgttggtctacgtgtttattgtcaatgtgtttattgtctatatctccacctaggatacaggctttacgaggtcagaggtattgtttgtttagtggacagctttattcttagtgcttagaataatgactggcctataatagtcagtcaaaaaaatattcactaaatgataaatggatggatgttatttggccctcctctttccttttttccttcctctcagtctcaccctagcaactttgacctctttttgtgttctctctgcttcattatgtggggcagctcagttctttctcacccttgctcccagactcaaaacccagcctttctgtgctcagtgaactctggtcaaatagttagatccattcagggtctcagcctttcctcactaaagtgacctcactttatcagatgtgatctgaagcacttagtcaactctaaaggctagtaacacatgatgaaatatctaaatgaagaaaaaaacacttaaaacattttagaaagtataaaagtaacttctcaagtccaataattatgagctgaagtcaaagttataattcaaattactgtaagagtaaatgcccctcaggaaacaaattcaaataaatagccttggtagacgtgttgtagatcagatttttaaaagatctggtttaaagatatttacgttcaaaggactggttcataattaccctgcttttgaccatctgtgtagtggctattaggcttctcaaaagattaatagtcatttgagttggtaacactaatttcccagaaggagtctttatttcattaaagtatattataaaattgctcaagcattttattggaagtgatggttaattacctatggggctatatacattacatccttcaaaaaaaggtctcttccagactagtttggagaaacttatctttctcacatgtagttcaagcctttactatagtagagaagggtgttatcagttcttggttttttttccctcttcctgcaagctaataagtgtgttgtttcatccaggttttcagtaaagacatgagactccttagtcagagacaaaggattttgttacttatggcacagcaaacagcctaaacattagtaagttcacttcagttactctttccttaagtccccaaaagatgatacagtgagtgctgatgagtagtttgcatgcagtggtgctgtgtcatagatgaggaactctgagcctgggaaatttatagcaacagtaaacagtaagccagcttgctctttgtcgtacagggagtcattaactcatcccttaaggttgattgctgcaagcctaactctgaaaagtggtcctggtagggaggtcatggctttacactattggcatacccagcaggtcatgtaggggtacaagagactcatagtggactgtctttcaacactatccactccatggtcttatgtcatgttagctgctggaaatttttcttatgagtattccactccatcagtcattctgattaatttgactagagaggtagagagtaaacgcatagaatttgtcttacacaagatttaattaaggctactgtcagtagaactctaagcatgaagaggagaccaacctgcaatagcaacctcaatcatgcctcataggatcctagattctcccagctgtgaataagtcccaaagtacagacagctaggatatagtgtattatttaatatgacctacacatggaaatttagactgacatgctgatctttgttttaattgccaaaaagttaactattattcccaatatagagatctcctatggtccctattccccagacataaacataaccaaaggtgccgaaattaatccagtttgaaatttattgctacactttatttgggtcagcattagttcactttggttaggctatatgagcagggtcagtgagtatttgaaacttctgtaggcattcatggtataacccaagacagtccagacaccaggggaaaaatacacgtttgtatgaatcagattgagaaaatgttgtgctgattcctgtgttttcacacttaagaggatggggaatctgtattgggaagctgccattcatgttgtagaaatgttcaggagaggccatattcacaggagtttttctgttttcatggaatgtggaaggagatgacaaaccaacacacaaccaaactatatggttgccttgccaggctgtgtgcttcatctagcatacaaagagagcattaatcctcactcgcttcacctccagtggtccaagattttcccttcctaggtgtcagtgttgttgctctttttatccacaatcacaaaatttgttcatcccattctagtagctaaagctttgcctttattgtggtcggttcctagtcatactcaaactttttgtctagaacaataaatagaggaaaaaggtattttatgacatttatatatacccattttatttattacctgggccctcgtggaccattgtacaataattcctagagcagaacactcaaattaatgatagttaacctcataatatatgaccatgtttgtccaacaaaagaatccaggtggctgaaccagaattcagttttaataccattctgaccatgttgctaccaggacagtaaacctaccaggctgttctaaggttgctgttaggagaaaaaaagaagcatcatgccttccacttctagaaagttagagaaggtatactttttttccattcatctcgttacatacagctaatgattctggatattacagatgttccttgacttacaatgggattgcttccccctaaatgcattataagttgaaaacactgtaagtaaaaagtacatttaatacacctagtatgctgaacaacataacttagcctagcctatcttagatgtgctcagaacacttacagtagcctatggttgggcaaaatcatccctaacaaagcctattttataatgaagtgttgaatatctcatgtaatttattgaatactgtaccaaaagggaaaaacagaatagttgtatatgtacataaagttcagtttctactgattgtgtactgctttcataccactgaaaaattataattcaaaccatcataatctgtgcataagataaaaaaattaaaagattctaaaaagtggggagaaaaagcccaactggttaagaaatttcagaaacgctaaagcagtgagttccatgagtttccttttgcctcatacaatcaggagtagccactgacctggaaatgttagtgaatatgtacaaaaaagcccaaagaccaggcttttgctttctttagccaaaaaaccaggagaataacagactgtcaagacacaaaactgaaagactataaccagtttactccagccaaataccacagaaagatttacagctaccaagcacatctttagtcaataaaaaagtagttgcaacctggtaggagaatttgtgttatttttaacttacctttgctccatctcctcatcactggctttaagacagtctttaaattacatcctccattccaagtatgggttcctggtgctagaagaagcagagtggaccttgttatatcaaagtagtgcttgattactttgacctctccagtggctcattgaagggctaattcaaagggcttgcctgtgtttcacacaactcaaaatcccctcagggtggagaattggctacagagaaaagtttttttctaaaaaacaatttgctaaagggacttaacagcaggtaggagaaagaatctacaaatgtgaagataagccaaataaaattattcagtctaagaagcagaaggaaaaaagaatgaaaaaatatatacctaagagcttaaatgacctgtgggacattaacaatagcacagacataagtataacagaattcccagaatgggaggagtgacagaaagattcaggaaaaatatttgtgatatgatgaccctaaactccccaaatttgatagaagacatggatctacacatccaagaagttcaaaaaggactaagtagaatgaaggcaaaaaaattcacagtgagacatattatgatcaaattgtttaaagaaaaagacaaattgagaacttgaaagctgcaagagagaagtgagtagccacatgcaagagatccttaataagattagcagtcaattgttcatcagaaaccatggaagccagaaggcagtaggatggtataaagtgtttaaagaaaaaagttgtcaaccaccaatttatatctggtaaaactattgttctaaaacaaaggagaaattaaaacagccccagataaacaaaaactgagtgtattcatcacttgcagacctgctctatgagaaaatctaaagggaatctttcagacagaaaagaaatgacactagacacttggagccatacaaaataatgaacaatgatgaaggtaattacataaataagaataaatgccaatatttttgtagtttttgtttataactcccattttcccctaaattatttaacaaactagtggataaataataattatagatacatattaataggagcacaatgggtaaagatgcttgtgtttttgcaggtgtataaaaatctcctttgttgtttttcatagtacaacttctgtatttcaaatgaacacaaaattagtagcatttgcagtagtatcttaaaataaattgcctttgaataaaatcttgctttccaatactttgaggtccacgagacatttctagaaaattttatgccatggaaaatgaagaccacttaatccagtggagaaggggagtgtgatttctctttgattgattgccataacactgtccttaaggcatatgaaggagagttctatatgtcatctagacattattaggcacagaagctttttcagtacaactttgatgttatgtaaagtgtgtcatcttgctagcactgatatcgctcttgggtacaacattagatctattgacccatactatttttgttacaaatattcaaaaggtgatttttttctacaaggactgtgcttcaactccacattcaattttaaaagttatatatttttttaaataaattttccaagactgtggcgactgccatcttgggttgctccttctttggtttttacagttactgagaaatggcttttgtgatttctgccacttgcaacgtactcttagagaaagggatttcgatattagtatattctctttcattctatttcctatgaagttgttggtgggaatagaaaagacctgcccaagccatcattgatggatactggctacatggtccttgagtagaaaagagcctgcatccttcatggcctccagccacaagcttctgcaaggaaacaaagcatgttatgaacaagaggaggaacagtagttgtttgtgcttctttctctgtagacacaattaagtttcttgcatagataacccttcatagatctgattttctgtttaggttgagatggaaaggcagaaagagacaccaaatttataacttttggaaattaatttgaagatatgagctttttacaagaaaggcaacgagagaaactagaaaaataaacagtcacacaagatgtcattgaaagtctatgtactacttcctaaacatactttgtgtactcacttcccaagggtaagatgggtactgcacacagaggcagcccaccctaagggaaggatcatgggaaaggggaaagcctataaagctctagggtcaaggttaaacactgcgctttacctcagtgccgggcttggctctcttccaagtgtaccttcctttctttcctattctaaagccttttaaaataaatttccacccttgctctgaaaaaaaaaaaaaaagaaaggctatgtactgaaggcaggtttatctctattataccaacccatgtaagtactgttttgacatgcatgtgtcattggtgcaagatgcaatggctattcccaagcccctctattccctggtcttgttaaaaaatgttgctaaggctgtgagctagaaccatgcttgttaagctagattttaggtcattctgttttgaaagaattattttgaattacaagaaacttctttaaaaattggagataacagaatggtatagggatgtgtggcctgacatgaagagctatgcaatgtgaaatgctccttgaattgcaagaatctcacctaaatttttataatagaatacttcatgactgttatttcagtgtaggaaagtggctattagaaacaactgctcttactcatacaacaattgccatttgatatcatacacatacacacataaacatccccacagacattaacttggagcatttgcttctcaaatttttaactgatgtgtcagatttttaaagtgacttgtttacataataaggctctacattttgagtatatgtttgatcactatcatgattccacaagatggcagtgtgttcttagggaccttgaggacagctctcaagtgctcgtgtgtgtgtgtgtgtgtgtgtgtgtgtgtgtgtgtgtgtgagagagagagagagaggaggaggaggaggaggaggaaggatgaggggaggggcttagtggtgaattaggggtgttaaaaagagcatcatttttttgaactggtaaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgtgagtttggggcatctttatataggaaaataatgtacagtatctggagttactgtctattctagatctataggtagaagcatgattttttttctaactaagggaaagtaggggcaccagtgaaaagaggatttaaattctggggagtaagcatctattacccagccagtcttctctgtctgaccactgtctttttcacaggggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacacacagtgctccccagacacctgcagtctgtacccaaacctgccatgccccaggaatgcctgatgtagagcttagactgcagggtagtgaaactccccttgctctctagtttcaagtggaaattataagaaccagtatggaggattaattaattagggaagtattttcataattctgaaaataattgaaaccctgaaaaaaataaaaacaaaaatcttggtctggttgacatattttttagtcctgtttttccactatagttttaaatatttttttaattgaggtctgactgataaacaaaaaagtatgtgtatttactttatacatacagcacaaactatgccataacatatccataatttctaaaagtttacttcctccctccttttttaaaaattgaggtatgattgctatataaaaaggcacacatatttaatgtatacatcccgatgctcagtctagttttatgccacctctttatgagattggttttatggtttttaaattacataacaagaaaatattttcacacaatgacagatattctctcatagttcccaggacaccttcgtctttccttctttagttactcaaagtgtttgaaagtcattaatttgggaatgcaacagcaaaacaggaatgcaaagcagagaaaaactcacaaacaaatgacttcaaaaattctacaagtcaaaaattctttttttttttttttttgagatggagtctggctctgtcgcccaggctggagtgcagtggcgcgatctgggctcactgtaagctccgccttccaggttcacgccattctcctgtcccagcctcccgagtagctgggaatacaggcgcctgccaccacaccggccaccatgcccggctaatgttttgtatttttttttttagtagaaacgtggtttcaccgtgttagccaggatggtctcgatctcttgacctcgtgatctgcccgcctcagcctcccaaagtgctgggattacaggtgtgagccaccacccccagccaaaaattcttttaattatagaaacctcacctcatctccagcctcagccacagcactactcctgatttatgtaagggtatatttcatggatagatggaagaactacagtcagagggtaagacctggttaaaactagaagtctagatagttgcagtgactaaatattagaaaaggtctatgttgccattttggggtaaagtctgaactgaactcaaaactcctggcttgagccttgtaaaagaatatattaatacctttgtacttaagtgtggcttggagatgatagggagcattagccctagccacagcatgccatatctccagtcagggcatgggagcatggaacaatctaaaattcattgagaaggatctctgagtaagtatcttaaagaggtccagacactaaggggttttagtataatgagcaaagacctgtgtgaatcaattcccaaagactatatggtattgagaatgtttcagcaaattttcgtcaggagagttggaaatgctgaacagcatataaatgcctccctccgctgactacctggcattatagatttgtcctgcaatgtatgccaagtccacgaaaaatatttacttcctaatgaaaataatgccatttaatatttagtacattgagttataggaaaaagcttgaaaagtgacatttattgtaaaaccgaatttgtggactgttagtcatgacattgtttaggtagtacaggaggtggaaaaattttggaaatgaagaatcaagatttctattcagttagttcacgtagttactgatgaaagatgcaagccaatcaacagttgcttcaaactgttaatttacagaactgaagatttaagaaatttttccaagtcatgtaagatttgtaaggcagtgaggatgatcagaaagttgtactgaaataaaaatacttaaattttagtgccacttttatcatatgccttcaggcaccctggcactctggaaagaccctgggctgccatgctcgtttgaatatcaattatgttgctaacaggccgtttatattaagctgtactattatatatatttcaggtttggatttaggattaaatgagatgaaatattgtcttgggataagttcattagaagcagagcctgaattggaaattctttatccataattgattgagaaaaccgggtcgagatgggaaaaggctaagcataaacgtgccagctagtggagtctttatccaccctgacctcatgggagctctggagcatgaattgcatcacaggattgatcctttccacactgaggcaagggggccagaatgctgacctattgtacgtaagaataaagtcgtcattggctgtggtgtttcttggggtagaggtatactctactggacaatgatgactctcattggcagaggtcgattttctagggaaaggggcaactgtgagctgagagtagccaacattcccaacagtaatagcgacaggagacagacaaattcctacgcagacatggacagatccccggtgaaacccggccttcaagccaaggacagttcaaagccttaaaaccgatctgccagttctggatagaatacatagccagagtgagaacttgaatccccactcttgcccactctctcgattggttccttctggatgatgccttttaaccaatcaaatggtgctttttccaagaccacctatggaccaatcagcatgcactcccccattctaagcccataaaaacactcggccttagcctcacagagggctacacactttgggtcccgtcttgcttaccagaggtttcctgtcactcagtaaaattctcctctgccttgctcactctttggtgtctgtgtacctcattcctcttggccagtgggacaagaatctggaatccaccgaactgtgggagtgaaaagagctgtaacaccctctcccactcgctgaactacgggagtggaaaagcctctggatgccatttcctcctgctctccgaactacaggaagaaaaaagccatgacagtagctggggatggcgacactgtcctgggaaaggggatcttggctgggcacaagcagtgttcactattaacatggaactcacctggcatatgggcagcattcaagaaataatagactttgtaattatattctgaattttaatttcattctccatttgaaggagtttatatagctggctttcccgatcttgaagagttgaaataatgttaggttaaagcacttcttcttcttcttttttttttttttttttgcactaatcacatgtagtgattttattttttatatatttttatttttttctttatttcttctaaaaaaaaacaggatacatgtgcagaacatgcagtttgttacatatgtatacatgtgtcatggtggtttcctgcacctattgaccggtcttctatgttccctcaggctaaagcacttcttaacagaaagcatctaaataaaggtaaagaaatattattcaaagctaaaactcaagatattttaagaataatgactaaggaaccactatgttatcttacttccttttgagaatgattacatgacattctgttcatcactttgtattgaggtagaaatgactctgatgattcacagttcatgactctgggcttccatgtatagagacaacaacagaaagagatcccatctatacttatacatgattaatgctattttgttattaatttgtatttaagaatggaggactgggtaacaggatggactcttcatgtcactgtgcccatgttccccacaaggtttcttctggaatggggtgcctggccagtagtgtgggtatgtgggcatatcatgtgatttggcaggcttctttttaggatgaatgaacagggaagtggtaattaagttgctcctctttgttccttgcacctaatatcattgaagatggcctaattctgtcaaccactcataataaaactgcagtaatcccagcggttcatttaaactcttgtgaaaattaaatacccaagtaaaagttggcttactatgcctatcacacacaagtacagaagcaggatggtgagaacggagggaggctagtgtagctattccatgtgtggaccttcagtatgttctcttgtgttctgttcttcccactctccatcacctactttctttctcaacccggaacctctccagggtctcacccagtaggttcccttcacttgcatttccactgcaatcttctcatagttcattctgggctggacttctcccccttctctgtttcatccatcagtgtgctcacatctacttttcatttcatgggaattgtgatagctttcatcttttcattattacttttaccattatggattcaagtcattctttttatacttctaaattttatttcagtgggaatattggaaagataagacgagaatacatatgcttcttaggaattttgaatcagaagcacatcctagtaacatttaaatgttcaaactggctatatgattttgtcttacacataaaaaatctataggcagaatcaaggaatagatcagaagtgcaagggagaactgatttcaggctggcgtgagtgaacagagtacacagaaaggagggattttgttctgaccttgtgaaaagaatccttgttggccaggttctcatttcacctgagatttctctcctcatttggttttttaagttttagggtccaatgatctctatgctaaaataagttggatgaagatggcttcttattcaagagtttcatctttttaggccagaggcgaccgctccagttcaatacagcctatctcccactcacaggggactactgcttgcctagctctgttgagtatcactgtcaatctctcccagattttctatacctcccacaaggtcctctcatttcttgtctgctggttgcattcctcccaattttctgagttaacacaggtttattttacttttcttttcctaactcttcccaggattatttatttgttatattttcttacactcatcattccactcaagtttttccatagatgggcctctgttaatgttctttttagtgtgagatataatttggcatgatgtatcagactgtaggagctttgacaattggaacatgattctttttaaacatgaagtacctaagttgttttttcctagagttacaaatatcgaagttattgacctgaaaccaaggggcctctttaacatttttgcttaacaaaaaaaattttgctttatttgtttgctttgattaattaattagtgacatgtgatccatgctgattttaagtatgagactcaggtctagtttgtttatttttttaagaatcaaataaggaataatctctttcacccaccgtaatgctgacattcagaaacacagggccatatgaaactcagcccagactgaggcaactgatcacctcccttctccttgatgaatggttttacaaaataatatagagtgtctcaatggtattccaaagtctagaatgttgtcttctgtgactagttgctcagtaaagtaaattagtcttctatttttacattactctcatttctcatgtatttaggattaaaaccatgtactctacagaaggtgacgtcatcacagatttgggaagaaagaaacactttctgttggttttgataccacatttctcaaatgagaagcaaacagttcacttccttggatccgtggtttcgcctgtggccttcagggggcgacgttgcactaaggaggcatctgtgttcattgccgaccatcctcatccactgagcctcctccctgcagctggctgatgtagctcactggtgtctgtgtagatagggagctgtgatgagaacaagaggtcagaacacatccaggctccttaagagaaagcctttctttaaccatttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggttagtaacattccattacctttcttccttttgtaaatgtgactgtgttgtaattttttctgaatagagacatcttttcttcatagcaaagtctgtgctgcctttacttacacagcattggtgttgcaggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgacacagtgcttgagactgcaggagaggtgaacataaacctcctgagatgctgagactttctgtgactcaagaactcaaccttgaagtctgttttataatattaaatagcatttccaagtttctgatgcttattgatgtatgctgtatctttttcatctatttatttttaaactatctgtgactttaaagtgtgtttcctgtaggtagcataaaagaccatcttttctttttatctactttgttaatctctgtttttgcattgtgaagtttagataattaaaatggaatataaatatcaatcaggttggatttaagtatacttcattattgtgtttcacccatgttcctttttttgttctttttttctgactccttttggattatttaaatacttttcaatttacattttaatttatttatgaactttttggctataactctgtactttttgagtagttgctctgaagatggcaatgtacatgcctaaatatccagggtcttatgtgagcaaatactgtacctccttatgtgaaatgtcaaaatcttacacaacgtctctttatctaccaacactaaagtttgttattgttgttcatatatattagtcacatacattgaaaacttcaccaggcctggcacagtggctcatgtttgtaatcccaacactttgggaggcagagatgggaggattgcttgaactcaggggtttcagaccatcctgaaacaaagtgagacccccatctctatgaaatataaaaaaaatagctgggtatgatggcactcatctgtagcctcaactactcggcaggttgaagcattatgatagcttgagcccaggagttcgaggctgcagttagctaccatcatgccactgtattccagcttaagcaatagagcgagatccttgtctcaatttttttttttaaaaatcacaatatatagaaaacttcaccatataatgttataatttttgctttcaacaattatatgcactttataaaatttaaggggaagaataagaactattttatacttaacagctatttatcatttctggtatccttcctttgttcctgaagatctggattttctctgataccaggggatataactgaaattcccttcaaacttaaaaactccctttagcatttcttctagagcagatttgctgggaaacatatttttcatttgttcattacctgaaaatgtatttttaacttgccttttatttctggaagatagtttttactgggtctgtaattctgtgtcaacccttccacccctcccgctttaaagataccatttcattgtcttttggcctccatgctttctaatagaaatccattgccattcaagtaattgtccttcaatgatgtaatatattgtttttctctagctgcttcatatataagctatgtacacacatacacacacacacacacacacaaacacatgaaaaattatacaatcttttgttgtcagtggtttaatcataatgtgtttaggtgtggttctctttgattttaccttgtttggggcttgaattgataaatgtatgtctttcgagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaactaaaaagagtccaggaccagatggattcacagccgaattctaccagaggtacaaggaggaactggtaccattccttctgaaactattccaatcaatagaaaaagagggaatcctccctaaatcattttatgaggccagcatcattctgataccaaagccgggcagagacacaaccaaaaaagagaattttagaccaatatccttgatgaacattgatgcaaaaatcctcgataaaatactggcaaaacgaatccagcagcacatcaaaaagcttatccaccatgatcaagtgggcttcatccctgggatgcaaggctggttcaatatacgcaaatcaataagtgtaatccagcatataaacagagccaaagacaaaaaccacatgattatctcaatagatgcagaaaaagcctttgacaaaattcaataacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcgccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagctacttcagcaaagtctcaggatacaaaatcaatgtacaaaaatcacaagcattcttatacaccaataacagacaaacagagagccaaatcatgagtgaactcccattcacaattgcttcaaagagaataaaatacctaggactccaacttacaagggatgtgaaggacctcttcaaggagaactacaaaccactgctcaaggaaataaaagaggatacaaacaaatggaagaacattccgtgctcatggataggaagaatcaatattgtgaaaatggccatactgcccaaggtaatttatagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctaatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagttctaaaaccataaaaaccctagaagaaaacctaggcagtaccattcaggacataggcatgggcaaggacttcatgtctaaaacaccaaaagcaatggcaacaaaagccagaattgacaaatgggatctaatgaaactaaagagcttctgcacagcaaaataaactgtcatcagagtgaacaggcaacctaaaaaatgggagaaaattttcgcaacctactcgtctgacaaagggctaatatccagaatctataatgaactcaaacaaatttacaggaaaaaaacaaacaaccccatcaaaaagtgggcgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggtgattcctcagggatctagaactagaaataccatttgacccagccatcccattactgggtatatatccaaaggactataaatcatgctgctataaagacacatgcacacatatgtttattgcggcattattcacaatagcaaagacttggaaccaacccaaatgtccaacaatgatagactggattaagaaaatgtggcacatatacaccatagaatactatgcagccataaaaaaggatgagttcatgtcctttgtagggacatggatgaaattggaaatcatcattctcagtaaactatcacaagaacaaaaaaccaaacaccacatattctcactcataggtgggaactgaacaatgagatcacatggtcacaggaaggggaatatcacactctgggaactgtggtggggtggggggaggggggagggatagcattgggagagatacctaatgttagatgacaagttagtgggtgcagtacaccagcatggcacgtgtatacatatgtgactaacctgcacaatgtgcacatgtaccctaaaacttaaagtataataataaaaaaaagataaatgtatgtctttcactgaatttggcaagcttttggccattctttcttcaaatatgttttctgacccaatatctttcttctctccctctaggactccagttagatataacttagactttcgaatattttcccacaggtctccagggctctgcctttttttctttcaattttcaaattgattttaaggtttgtcagtgtttcctgaccttggcactactgacattttggtcctcataattttttattggggtgtggggctgccctgtgtgttgtagaatttttaacaacaccactggcttctccacactagatgcctgtagcactacataccccaagttgtgaaggccaaaattgtgtccagatttgccaaatgtctcctgggggaagacaaagtcaaaattaattggattaaataatctgtattgatctttttcaattttgcatatgctttcctctatcattttgctactgagcccttactgtaagatttttatttttgatattgtatttttctgttcaatttctatttttttctttactttgtggaacataatcaaaagagctactttgacatctttttctatgagttttagtatcttagtcatcttggtatttgaatttgttgatcttttacttaaatattagttcatttttctggccctttgtcaaataattttgaagtacatcttaaacatttcaaatattatgtgtgtacactctgttttctcctcctcttccttcttcttctttaaaaaacaatcatctaaagaatgttaatgtttttatttgaggagaaaatcaacctagtttggtttatactactagttgtgtctccccttttgtggaatttggtagctcaaaatcacagttcagttctctaatcatttgccatgttggtttgggtttatacctgtcgtgtgtagctcagggattagtgaaaccagtttgcatggctcaaatctcaggtcagttcctgaactctctgctacattggttttagtttgtcctgcatgggtgccacttgggggtagtctgagactggaatagtggttcaaatatcagttaagtaacctaaaatttgttgttctggtttgagtcagtttcacgtatgtagagccttgggattagcctgagacttaaactattttccatctcttccctagggtctcccttttctagcctgacccacagaggcagaaaattgtgtttcttgcagagttttgacttcctacaccattatcatattgctgtgtgcattggggcctccctcagggcaaagccaagagaaagaaacagaaaaaatatgaaattcacccttgtgcaggttgtttctccaatttttgacttccctacacaatctgctagcttttgggtaatttcagagtccacaggtagtttctttttttaaatttttttattgtttatttattttttattttgttcagtttttacttacaatccatggcagagattggccgtaggtatcttaaagttatctcctattctactgtggtcctgcattaatttgtggttctcgataatattaatcaagaatggctatttggcgtgtgcttttaccaccatctttagttgtattaccctttttagttaatctaattcattttttatatttgcaaatttttctcatcaagattataagaccatttaattaagctcttaaatttttttgatatttcatttcttattttccaaatttatgaaggtctttctttggtgcaaaagaattgagaatgcatacttgtttttataaataattcaagtactatattttttcctaaagtctaaaaatttttgtattctgaattatatctggatttaagagtatgttaaggcatagtaggactattcaaacactattttttttagtacataaaacagagctgattagtttttaattttctctatttttttcatttctgactttttgcttcttttaaatgaaacatgtattttggtatttggggctgtgtttggagacccttaaatcttccgggaaatcatgtatttcttagaatgctgccaacacccttaagtgagaatattctatttatgatcttattcttatttaactaagaggtgttgcttctactactatagaggattgaagaattcctttacattcttccagtgcagagcaaaaggcaatgttccaagacatcacacaatcctatggcctttgactttgaacatactgggctttgcaaatgctcagcaactttgagaaaagttaaaatgaccaccattctgaaattcagaaggagttgctccttatagcttattttccaattttttttctgctctgactttaatcttcaatatgatcccacctactttctgtgtcctagaaatatgtgtcaccctttcctcaccagatgaccttcattttttttttactcttgtgaattttagtctatttccattttatttctattctttaatttaggaagaaatattcaagagaagggaaatgagcatatagcattaggattagaagttcacactcaaaggctacacttttacaaaatgacagcattactcaattttcttcattcaagaaaatcttttccaacaggaacaaatgaatcaagaacccaaggagagaactgggcttatgctttcaaatcaaaggaaagaagtattctgactttgtcaagggtcccattagccacagagaaagcagtgactttctgcattctcgtgttttcagagttttatttttttccccatgcactatctacatttattattatttgtttttatttttaaatttcaacttttatttctcgcttggtgtggttgtatttccttcagccccacaggtgtctgtagttttattttctttacccctagaggcaaagccttcccatcatgagttacgccttgtcattagttgcatggaggcactactctccttatgtgaaatcttttcctctatggctgcacaagcatcatccgagggaaatatctctaccatcctccatcagcactgtggcaacactgaaccatccaaaactcagtccagggcaattggtctgaacccaaactctcatggactcatatctaaattctgatatgcttttcaataacgattcctcttgatgtattactccatctttacatgaaatcttattgctaatggactctaggactaaaacaccatcatagatttggtcaggaagaaacacgtcttgtggaagttttgatacatctcagaaaacaggaagaacacactaatgaacagtctgtgctaaactctggttctgcacttggcctccagagagcgatgctgcacacactggagcttttgtttctgttgaagatcagtccactgctcagtttcttcttcctgcagctggttgagttctttccagacaaagacaagtgacaagaatcagagttttaaaagcaaccagattcatctctgcagcttttgtagttttatataaacaaagagcttgtccagcaaaccttccccacacttcttgttcttggtctcttcagccgctttccttcctgttctctggagatcttgcagaaaagagcctgcagtgtttccattgctcagccatgctcctggtgctcatcccactgctggggatacattttgtcctgagtgagtaaaatttctttatcatctctagttccacaggttctgactagaaatgcttgctttttatactgagtctgcactgctttcactgatagtacattactttttcaggaactgtcagagcccagtcagtgacccagcctgacatccgcatcactgtctctgaaggagcctcactggagttgagatgtaactattcctatggggcgatgttgtgggaagtcagggaccccaaacggagggaccggctgaagccatggcagaagaatgtggattgtgaagatttcatggacatttattagttccccaaattaatacttttataatttcttatgcctctctttactgcaatctctaaacataaattgtaaagatttcatggacacttatcacttccccaatcaatacccctgtgatttcctatgcctgtctttactttaatctcttaatcctgtcagctgaggaggatgtatgtcacctcaggaccctgtgataattgtgttaactgcacaaattatagagcatgtgtgttcaaacaatatgaaatctgggcaccttgaaaaaagaacaggataacagcaatgttcagggaataagagagataaccttaaactctgactgccagtgagccaggcggaacagagccatatttctcttctttcaaaagcaaatgggagaaatatggctgaattctttttctcagcaaggaacatccctggggaagagaatacgtgcctgggggtgggtctatagacggcccccttgggtgtggccatcttctatagtcaaaactgtaggggtgaaataaatcccagtctcccatagcactcccaggcttattaggaagaggaaattcccacctaataaattttggtcagactggctgctctcaaaaccctgtctcctgataagatgttatcaatgacaatggtgcccgaaacttcattagcaattttaatttcgccccagtcctgtggtcctgtgatctcgccctgcctccatttgccttgtgatattctattaccttgtgaagtacatgatctctgtgacccacacctattcatacactccctccccttttgaaaatcagtaataaaaacttgctggttttgcggcttgtggggcatcacggaacctaccgacatgtgatttctcccccggactcccagctttaaaatttctctcttttgtactctgtccctttatttctcaagccagccaaaacttagggaaaatagaaaagaacctatgtgactatcggggcaggttccccaatacggcaacaccttctctcttctggcatgtccagtcccccggccaaggcctccagctgctcctaaagtacttttcaggagacactctggttcaaggcattgaaggctttgaagctgaatttaagaggagtcaatcttccttcaacctgaggagaccctctgtgcattggagtgatgctgctgagtacttctgtgctgcaggtaccacagtgcctgggtctgcaggggagctgaacacaaactgcctatgctagagaagttttcagagactcaatgtatcttcctgtggcattttcaaagatctcttatttttatgatggtgagtgaggcaaagagagctgagcacatccagccatttctatataattctgcaattcctgctatgtcccatgtcagataaactttgttttagaagctttttgttaattgaagaaactgcataataggaaatagtattctagaatgatggaggagacatacttcttatcacctaacaatcaggttctcaaggacctttccttgactgtgactgcattaagtggttgactatgggaattttgatatggtctaggagaaccttggttttcatttatcatttaatctctcaactaacccagaaaacaaaacataagtttctcatgttcttaccttgcaagttgcatccttgagctggtcattcacaggatattttcttagaatttatttttctggctctaactgcgcaattcagatttcaggatattttgtctcatacctctatttaggaggaattatgagaaattgttagctaacagtgaaagtttcattagaatcacgaaggacttagaaaattgtcacagtgatgtgagttctggcaactaggaatagcacacaaggagaatgaagatttagaattcatcagtgtttctccaaagactttttcagttataaaaatagcttctattctattggtatattaattatgcaaatctacattgtaagtttgtctatggaattccattcatctcttctagctactgacacttttacttgttgctttcactctgttgttacatggtttcactattgaaatattaaagattgattctcttttttgagatagagttttactctttcacctaggctggaatgcagtggcatgatcatagctcactgcagccttgacccatgcccccaggctcaagcaattctcccacctcagtcagcttcctgagtagctgagactacaggtgtgcaccaccatgcctggctaattttttttttaatttttatttttagtggagacaagatctcactatgttgcccaggctggtttcaaactcctgagctcaagcaatcctgcaacctcagccccccaaagtactaggattacaagcatgagccactgtacctggccaaagattgattcttatatagtaacattttgataatctgtcatgtggtaagttttgcaatgccaagctctgctagaaatacggataagagttacaatggtactggattccaggcggctgctggaaagtataaatatgtgactttcttatgtctagaatggaaagaactgtataagaagattttatactccttgtctgcttgctgcctcggaggataaccagtgcttcggaggaaaagtagaaggagaaggagagagctctttagctgccatttagctcacactataaatgtctaagagggtaggtgcatagggaccctgaaaatatagatcgaataagtaaattgtggccaatggcactccttagccaaatagtgaaccaagatatcaacagtattttttaggatgtagtgttatgagtacatgtgataaatatgtttaagcgatttctggaatgctgtgaggaaggtgaatggagtgtcagatatataaaattatgaaaaagaaatgtatgctcatttaatgttcctgcctcagtcccttccttcttttctgtttttggaccacactctcatctaccactgataaggcaaataatttcaagtgactcattgtcatcagctcagccacactgcccaaaggtacttgtcatagtatcatgagcacttcatgcagatcgatttgagaaagaactgcccgtttcttttgattctgatctcaaactgaatattaaagaaaaataaattccataccaaggaccctgagcagctgggagagcattccccatctcccctacctcacctctgcctgaaaaatcaaagtaatcttccttccttctattaataatttgttgcttttatatgagtacgtgatttgtaggagaaactttccaaaataaggaattatattaagaaagtggagattctgagttattttatcaatgatatcaatcattctgacttttcagaaagaattctgacttttcatgaaattaactgatcttaccacatattccatcaccgagaagcagctgccctaattgaaaggcggaacactttactgaagaccaagctagagccctgactgggagacaacagcatgtatgctaaacattttcttctctccctacatcgtattttttatctgatatacaagctgttggaaacaaactttataatttagtgtaaaggtaacagaattttcaggctgggtgaggtggctcacagctgtaatttcagcacggtgggaggtttaggtaggaggatcacttgaggcaaggatttcaagaccagcctgggcaacatagcaagaccacatctctacaaacaattaaaaaaattagccaggcatggtggtgcccacctgtagtcctagctactcaggaggattgcgtgggcccaggagttcaaagttacactgagctgtgatcatgacactgccctctagcctggatgccagagcaagatcctgcttttaaaaaaaacttaggaaggactgtcactgaatttgaagaattattaatataatcagtgatgaagtcaatgacttttgggattgtgcatcttctcattttggagaaaggatgaaaagttcttcagttgcaagatggagttctgtatcttgaaggagatagaggaatagaattattttgttgttgtacatgtttcaaatgtttgtagaagaatgtgtgtgttgcatagggaagcttgaagtagttgaaggtatcgatttattgactctcagctccaaattcactccttgcctcttctgtgaaggtgaatctggaaccttcgaccatttttctttgccagttgacacaatgttaagctttgtagtagagagtcaggaagaaaaagttttgctttctgctttccatgtgctcactcatcaggatcctgcaccatgggaggcacctgcagtgcacagtgccctgcagtttcctccagaacccccccattttagggcgattctgtgaaagagatcctgcagtgagacacctccctgtgaacagctttccccagtgtcctagaggatgattttctgccatgttctagagggtgaatttctagcaagttctgctgggacagcaccacagcaacttccctttcatccagtgagccacagctgtttcttttcaataagatctgggtctcagccctgagggtggggctacaggcctcttccctggttatcctaccctgccctaggagtagaggctgcaccttatgtctgctattcctacaggaataggaatagcagaatttcttttcttcatattattcattctcttgttactctaatactctgtttattaatccttaaattttttctgttgaaattctatggtttctctttcctgattggactcgacttagacatgcaccaaggacttcaagcaactggagagcatcttccatctccccgcccactcctgcctgagatatcaaagtagttttcttgttttatttctctattgatttgttttgcctgcttattgttttatttacattgttgttatataattatgagaaaattttacaataattttattaagaatttggaaatattgttaatatattaataaaattaattttactattaaaatttttgtgcacattatacacagaatgttattataccattggtgcaaattgaaatcaattttaaaaggtttagcatactgcacaaataggcattaattcacctatgaggatgtgtctggagatcgtaattctaagtcatttttcttgcatgtaactctctcaatacatcattattttttgattttctatttccttcagatggaggaagaagacaatgataattgcaaaactatctgtagacagaatatttctgtcaccccagaaggttttatgtgtgcctttctagtcaactcaccttctggaggcaatagatgttcttatttctatcaccttagatttactttacccattgtagacttcaaatcaatggaatcatacagtagttactcttttgtgcctggtttctttcattcatcgtgttttttagattcccccatgttctcatgtatatcagtcattcattattgctattgctgagtagtatcttattatatgaataaagcacaatttgtttatccattcagctgcgcacaccactgactggacatagaatctttcagggattaaatctttggtatcattcttaagagtgcaaggtacagttgttctagatttttctatcctgtctttcaagggtagggcgtgtctctaaaatacttcagttgaaacatgtatcttaaatacctttatttaaaaaccaatttctatcattcattatggtacctactgtatcattagttttgcaaataaaaacccaacatctaatattccctatgctatttagcaaagctttgggtattatccaagctgtgggtagctgaactgtagtttcctctgttgtggccttacgtattaataacaacagtagctgaccaccctggaatttgctttcctgactaagtcaattgactctccttagagttgagacttaactagtacatatccaatattctctggcttttgtcgaaaagatttaatgtaaattatacatcctaacactgtgatatatttatttttacttggtaactgatagatattatgaacaaaatttagatcattgttcctgcaggtcctgaagatctgtaagtcatgtaattataatccttgctcaacagttattctagagaacttatttaatatttagaggcactttgccctttacagtacatactaaaaccttttaaagcttgttaggtaacttatgaagaaaatttcactaatctattatttaataccaaatatacagcatatacaatacacattttcaatcttttaagcacattaacaaagttctcaggatagttggatctctgtacacagttttttacaggaatatctaagacaagggaatacctttatttaggacacaaatgcgccaaaacatgggtataaaagtagaatgtggccaggcacggtggattatgcctgtaatcccaacactttgagaggctgaagcgagagaatctcttgagtccaggagattgaaaccagcctgagcaacagaatgaaatcccatctctacaaaaagtaaaaaaacatcagctgggcatggtgacacatgtctgtgatcccagttacataggaggctgaggcagggagtattgcttaagcctgggaggtcaaggctgcagtgagccgcaattgcaccactgccctccagtctgggaaacagagtgagaccctgtctcaaaaaaataaataaataaaaataaaaataaaaggtagaatgttaaaatgttgaagatagtttatatgtatatttataacttcatattgttttttgtgatatgtcttatataataggaaaataaaattgacctttatattaatattctaaggctggcataacaaaatatcacagactaggtgacataaacaacataatttattatctcacagttccacaggctagaagcccaagatcaagttgtcagcagggttaatttcttctgaagtttgcagatcatgttgccttttcattgtgtccttacacggtcttgcccctgagggtacgcatgtctgtgtccaaatttacttttcttataagaagagcagtcatattgaattagagtccacttatgtgatgtcattttacattaattatttctttaaagagcctattttcaagcaccattacgttctgaggtactgggggtaagggcttcaacatgtaaattttgggttggatagagctcagtccataacaactctccaagtaaatattacgttcacaaacaagacagttgaaacctttctttgtgcaatgctttactaacttctcgtgcacacaatgatcgtgtataactttgatggagattttcctgtattgagtttctttctagaggaaggagaaatgtgcaattacaaatacagatagcttataagatattctacattgcaaaagaccagtgataaaaattaaaagctgtttttcagacttgccttctttttcctctgctccactggggtgcagaattctctcatgtttagatttgttcttttctgaagataaatcttaatttctccttggtattttatctctgacagttttcctttctttccccattccgttttctgtctgcatgttacttttttttacctctgtcttatcgtttgtctaatattagattctacctgtgcagaagccaatttagctaacttgctgtttttctcctgcactcctcctttaccacctcatcagcagaactgacatttaaaaaagaaaaaagaattgaaattcttttgaagttgtttagggcaagtgaagcgggttaagtggatgaggaaggtggctacagtccttaaacacaggggcagcaggaagaattccatcctatatgctcagctttcttgaggattgttttctgttttttttttcaagtagtatgtatcaatattttaaattttgattcaaccagataatcttttttaaaaaatatatgctttggttgctgacatgcttggattcattttaaatatatttgttttatgcagcattctcttgatttttttcttatttctttttagcctggcttctcttgcattgataaagtttgatttttcttcatactgctttgaaaatgtaatgtgtatttctgttatgataagtacccttgttatataaatgtatgtatagaaatataaaatacatatgaatgtatgtatatatgtgtatgcatatataaatctaatttttatgcccaatgttattcttttttttccctcagtgttattctgtaacattttgcttgtatatcccagtccttctcctttacctcctgctgacttatgaattttagaattaccttcgtggctgattggaagaaactacacataagctatatacatcaggacaataatttcagtaagatattatgaaatgaacaataaactatagctccaatgtacattaagaaaagtaataaaaaagaaaagcatccgacacaataattgcaacatgaatttgctcccttcatcctcagagccattgtccctgatcttccttctgcctggagtgtttttcaccattagccacatagatcccttcactggctcatagtctttgctcctggagaaacatgggaacatgtgaataaagtagaatgctcaaaaagtttattgcagcattgtatttcatagttaaagaaaaatcattgtattagtccattctcccactgttataaaaatgctgagacatgataatttataaagaaaagagatttaagtggctcacagttccacagaccatacaggaagcacagtagcatctgtttctggggaggcttcagggagcttttactcaagatggaaggtaaagagggagaggccgtcttacatggcaaaagcagaacctagagagaaagggaaggtgctacacacttttaaacaaccagatctcaggagaactcaggactgtagcaagtgggaaatccacccccatgacccaatcacctcctaccaggcctgacctccagcattgggtatggaatcctgattagggaaaaggagtcaggctagcaggaccaggggaaagcaaagggataaagaaaataagctataggtctgcctttttttcatggtccaggacatataaacagaaagaggaagcagataagctataggtctttctttatggctcaggacctatagctctcctgagcaaataacgtacataactcacagacttcctgcttatcatcaaacacctctatctatcatcaaaaacctcagttgacagaagaatgcaagttagttccttgctaccttggcattaccagtactgcatgcagcactcggcaacccaaaaacatcctataaaatctccagcaggcctttgtttccttgccatcagctcctcttcggctgattgctccctggcaactactttcatactttctttaatagatctgcctttctttatctacaacagtcttggtaaattattttatccccacaccaccagcccaggtagtcatcactcacctgggacattggggattacatttcaacatgagatttgggcagggacacagatccaaactatatcacacatcatcttaagtcttcatcaatagggagaggactatataaactgaagtatatctctaatagggtgcaatgtagcagaagttcccgtatgtgttaatataataagctctgcaagatatattattgaatttatagtgtgagttacaaaaaggtatacatgagatgcatcatttggtattaaattttaaaattataaatgaaatactatttattttcagcattttttgtatttagtacatgtatataatgctatagtaaaacatttggaagtatcaactccaaattgataagatgaagggagaattagggtaacgagtgatgaaagaatcagaactgggagtggtagtaaaagtggattttcgtctacctggtatgttgtattacttttaataatttcaaatgttcatgaattctttataatattaaaccaataaaaagtcataaaagccatcataaaggtttatccatattctattctattatcctcatgaaaaaggagagaaagagggaaatgaccaccctttttataaggtcttgtccaaccttcctaagtatttctcccacctctgggatcatatagcttttagttcacattctgcttaggatcccactctttgattctattatagacatgtgtagttttgtactcttcagtagattatgaactaatgtctcatcactttttacatactcttaaaacctaataaattaatcacttatggtaatacttcaaaaaatctttttggattttctaaaacaaaatcagagaattcaaataaatagcgcaagatgggaattgtcaaattattttaagatattaatttccatgaagtggcattttaaaagtggtaattggttcactgttaatccccattcagtctaggcagctatattgttttctgaccgcctccatttccttcataggaaacatgaagtgaatggggctgtgtgtgtgactactgaggagttaagttggtgcaaagtggtctttgttgatggtttcagtccactagggggcactctaggacttccgaaatgaagactttttctgatggtctcagcggacggaacaggatacaaaagggcatgtgagtcagtcaaatcacagataacagggagctggggcggggtggagcgtgatgtgtgtgtaaggttcatcttaggttttcagctctgacattctatataaaacctcagaaagctggagttcataggtctataaatccattgtgaggatgattctgtaagcagaggtaagggaattggagttttactgggcattgcgagcatggatgttcattagaaaacatcttcattccatgttttcagtttctaaatttttatgattaaaattcatgaaattcactgacttggaaattattctaaatacccctgatatctgatcttttcatatatcttctctgagactagaaggaaaaagaataaacagaagagaagaaaataggaataaaataaggatgaagaacagaaagagaatagggaggggacaatatttaatttgaccagcaatatgtggcctgatgagaacagctgtgagggcctgcagggtgtgtggggaaaggtctgggaagaggaaggggagaggtagaaatgcaattagagtggatatcatacgcacatcctatttttcctctaaccaaccaacctctagttggaaacattttctaatgccctgatttcaagaaactatttatttctaaatttgcaatgcatgctatcaaatagttttcctttattagaattttcatatatttgaattctccaattttctgtcaaactgtgtaatttgggaaatgggatctctcttcccatgactctttaaagctctatttaacctagctgagacacagattcttctgagaggtatcatcccccttcctcacatactatccataaactagtcttacataaagtgcttcttttttttaaaaaaaacctatatcttcatacattagaaatattgcctcttcctctcgtgaactattcacacccatgaatttggagagattgctgtgcagtctcactgggccactgtgggtggtttcctcttcagatgatttttaaaacttatgtttttaaacttaaaaacttttaaataaaagactgatcatgaacattgcaataaggcaagttgaagagtacctgaatccttcaaaaagtttagaaactctagtattgaaaattaatacattacaatttgaatatctgcaggtttcaaaatagaaattaaatctaagtgtagcagcttgatagaaaggaacattattttcatgcaaagttttgaatgacccagttatcgacatagaggctaattttcaaatcaatttttcttataattgaagatacaatggtaggatgcacaaacaaacatagtgaatcatatacatatcatgaagccactttgttacttttttaaacaaatttttttttaagagaagtggtcttgctctgttgcccaagctcaagtgcagtggcacaattatagtttgctttagccttgaactcctgggcccaagtgatcttcctgtctaggtctcccaaagtgctgagatcacagaagaccctgtctctgcttctgaaggagcccaaggattggttagggtaagctcagacccactagattgcctgtgggtgtgaaaatggtcttgggagttccttgatgcaggataacttctgcctactcccatgctctatgctgtacacaatcagtcctcagtaaatatttgccttgttaaatagtataaaagaattttagacctataaaagcatttagaaaccttttagttcaacttcattttataaacacagaaactatatccaagatgccagtatgaaaccattagatagtaaatgatctagcagtagaaagaaactggatttcctcccttcctccttagcttcttgctcttgcctattcctgcaggcacatattgttgaacaaagagaaactatctaatggcagccctgccaggttgacctctgcattttggttccgggaaaggcttggttcaatcactttgaccatgagaacggagagttccagtttgtgtaaacatttaccactttgggcaagaaagatattcaggctgagccactgttattctaccaggaaatccagtccatgactcactggctgctgtaggagtgagccaaacatggtggtgccaccctcaacccccagaggtatttctaaggactttcctaaaaatagtaagatatattcattatgctgggtggatattccttgaaggaaggatgtggacatagtgagcattactctacattgtcaaaaaataataattagaatagggaagctaagggtaacatgtcctcaagtggttgatagttcataaaggtgtgagaaaatcttttctggaccaacacattgacaatgagttaggtaatattcaatgaaataatcatagggttgggaattttgtccaggggatggccatacctaaggcatagttaatatgtggaatactatgatccatatgagtggtcatatttagaccattacattcagttcttaatgctatactcaaaaggccaaatattgacctaaattatctgtcaccaaaaggagggaaactcatccaataaaggatttgagaattatattgtatgaggaatgagtgagaaaagagaaaatccttagaatggagaagttttacatatgtaaaaacacacattttatgtatacatatctatatttatatgttttagttgctatttttcatcataactgtccttacatacttaagggtgcaagatgtgaataagaaattatattcagtctttataattccaggggcctagtgagtacaagtcacaggaaatgcacttttcttctggaaaccagatagtcttggtatctgaggaaccatttcccatggtcacttatttagttttgcactctccctcctagcagacacaggcaatattttggcttccatagatttagttttatggaagtaatcagaacgtatcaaaaattaaagtagataagcaattttttttgcaagaagagataaacccagaaatgtacaagactgaaggactttatcaatatcttagggaagaacactgtagtggagtttgggagaaaaacggcagatatggaacctgagctagcaatggctaaggcaagagcagtccatgccagaggagttggctcatattttagaggcaagttccactgaagatatgagtcaatcattgtatttaaggacatgccatattgatatcattcattttggtatcagaaaataaaagcaccttaatagaaatttacatgtggtttcatttttggagcctgcagcctgatgttttctgagaatttctccttgttttttctgcactttgcagaatacaagccacatagcaataggaaaaggtttcttaaaacatgccagatttctccttgcaaaccagcccaatctatgggtcaaactttcctattgttggagtatttaataactcatggaacttgttcccttcctcctttatcattgtactttaattctttaccttttattaaagccatccttaccaaagaaagattccacatttcgactgttggtactgtcaagtctctgggaatagaaagtcatggggaagaccagtcttggagaagcagagcctgagataatatgcacgtgaaatattgagtagtcctctctctcttactcttatctttggcttacatattcctttaagaaagagtctttctccataacaaacaaatcatgatgaccgatttgactgcaagggaatgtattacttttgtttgtccaggacagtgaatcatggtgttttcctgatttcaaacatgtaaacttggtgcatcattgtataaacacctgcaacatctacctctttctaactttttaacaatgactcattagtttgcataaatatcaatcttgatatctacattcttactgtgaacttcatctcagagtgaagactttatttgtttgacctattgctccttttgtgcatctgagtccctcctagggttatagaaaaacattcaaactgcaagtttagtagctacgaatgtgaccacaagatggcagtgcttctctgctgatgcagaacacacagaggtttcattttagtggattctgattaaataggtttatggcagaagtagagcctttttctattggctgagtagacaatgtgagaaaccactatgattgttagaggaaagaaaggaatacccgatgatggaagtagctcttatggctggagattgcaggtttatgactgatcctatttgggaagaacaatgatggcaggcattcgagctttatttatgtacttgtggctgcagctggactgtaagtttagagttttgggtaacacagtatattagttgatgattttgagacatccagggggaagtcttgctttatttaggcttcctctagttactatagaaaaagaaaattctggagaataataacttgataaacctttctctttttctttctgcacaggggtgagcagaggagagagtgtggggctgcatcttcctaccctgagtgtccaggagggtgacaactctattatcaactgtgcttattcaaacagcgcctcagactacttcatttggtacaagcaagaatctggaaaaggtcctcaattcattatagacattcgttcaaatatggacaaaaggcaaggccaaagagtcaccgttttattgaataagacagtgaaacatctctctctgcaaattgcagctactcaacctggagactcagctgtctacttttgtgcagagaatacacattgctttccaggcatctgtaaccatcacccaaacctgagatgggaggtgaagcagcatccctttcctttgcaataaattttagttatagcacttgtcattttgtttgttcataagtggaaactaacatatagatattaaaaccatgtaatgaggttagattcaaagtgacccagaaaggtttagagcattttgttggccagttgatgcttaatggattccgtttttcaaaaaaatatatggtacgcatttaagttaacaacatgaagttttgacacacatgtacatagtaaagtaaagagtcagctaaagagacgcatagggcaaggtatgggaaaaatggccctgagcttccatgccttctctggctctgccacccaccacatgttcagcaatcaggaggttctgctcaagggatccttacagagatttagtgatgttggattttgtaatctagtcttcaaaggtgactttacatttgctattcagacttctctcctatgaataaccccttagtgtcaatattgcaatccctattatggataaattttaacttttagttttcaaaaattgcttttgttatctttttcttattgtaaaacattacatgccaaaaccagatagtgtaaaatataaaaaatacaaaattgataattctgtacccagataggttttgctaatattaggttggtgcaaaagtaagtgctgtttttgccattaaaagtcatggcaaaaataacaattacttttgcaccaacctaatatttagatttgtttcttgatagagtcctattataattaggatcatgattttttcacctattcttatatctcgaattgagcttttctcacttcgtcctctcctcaaacacatgctttttaatagctccgtgagaaattttcaccagtcacagttatttttattttcttactctctgtatctgtggtaaaatttggcagtcccttctacctgctgtttcttgttgggaaaacgtgatgagttttcctttagagtctagtttggacatatactctgtgtgtgcgagggaaattaaaacaggaagtgattttaaaatgtgagcttcagattagagtcatcagtatattcttcaaaatcttattggtatctcttcatatttactctctcacataattgagaagagttatgttttttaatcactctgtttctgcagaacctagcataagctttttcacattgttaataatcaatagatgtttgttaaagaaagaaaaaatggattaaactattgtatattcaaaattttaacttaggctttgtggttgaattaaacgtataattttatgtgtgaataattaaactcctgaaaatgtatatttgaataagttgaatatttgagagcatatttctttccatttatctatgtcattcttttccataaaactttatcgttttaagataattaaatttttttctagacatttcatttttattgctacctttatctttctttctgaggtatgtggcaatgtttttaataaatatttttcagctacattattcaattcttattagtaaattgcaggaggcatttggatagttaatttatgctaggttgttccaaataccccgcctcactttcgtgttttgactgctttaaacattacgagtgcagtttccttttcaaaagttgtatcttttcgtgttgttgataaaaataatggaaataaagaagttgcataaataattaattccctaattctcccacctgtggtcaagagtaggctaatttcaagatccctcatattattcctaaggatggatataaccggcgattggtagggtgagaatgatcccttctggctgagttatggctgttagttattagctaggtcttataggaaaagtcattagattaaattggggtttaaaaacaactgaacaaggaaggtcagtattgtagcccagtaactcaactggcttttgttatttccctgtctataccactagctcctctccggagaagcaagctgactcttgatcagtccatttcctccaagaatgaaatggagtgattgggaatcatggcttatagtctatttattttttgcttgtttagaagaaagagtgtaattgctattggcttaattgctgtatcttacttggttgtcaatttttccaatgtaagaaaaaaaattatccagctagagtgtgcaaagtcagtacccagcttagatccagacacattcaagcattaaactttaaatggaaaagagtactgatgaggagagacattagcaggtaataaaatttactataaaattaccttctgaggttggcatacaatgaaacagatcaaaggagctaaataaaacacattgaacaaataaaccaaggtttatgtatttttttgttgcctctgtacaaacttgctgtcttaaaacaatagatacatatttttttaaatcatcttcactgggctgaaatcaaggagtcagtaaggcccgcttcagaggctgcagagaagaatctgttccttgcctcttctagctttgccagcatttcttggcttgtggtgccatcaccccaatccctgttgctatggtcacattggcttttcttcttatgttgtcaagaacacatttccacaagttcaaaggcaatatttctttgaaaatttttttgaataccaagtcacccaggtttaggtaaagtaaaagctgattaaatgaaaggccaggaaggaaaacctgtacctgttggttaaaggactgaatataatgagtttatttatctattaatagttaagtgtgtcagaatggaatatgtgtggttcagaacattctgagtaatatgggcctactagtgaccagttcatagtgagatgacacatgactttgggatggggaagaatgcagggccactagagctaagggtaataatgctttaggccacgggagttcacagatgtctgatagggtaactaattttattcttaatagtcatacattgtttcaacattttcagaggaccaggaggtgataagaaaagcagtttctgagtgagagcaaaaccttacataactgtcctagaaaaacatgttcctctacatatagataatttgattggcacagataaaaaatggaaatcaattgatttagctattgtgagtgctgtatctttatgacgggtgagtgcttcaacccatgtagaaaataaaacaactcttactagtgcatactcacaaccccttagggagtagaactgtctgaaacatactcaactgttcccttaggacagtattccagttcatattccacttttacagttttcatggaattttggagcttccaaaaaagacatgaactgtctgcattccctagtattctagaaaagtctccccacaaatgtttaatattgcagtcaacatgtccctactgcgatgggtggtccctggagggtattaacaagtgttcattggcaatcatctggttccaccaaacagcctttctggctttgatatatcttatcctcactgatcaaacaaatcaataattcatctaaggtggagttattgacattttccatggttgcatctttaagttccataagaggtgcttgcataaggactttagtcagaaagccatgtttagcatgatcccctgctcacgtatttttttctagcttctaaagtgcctttcatacatggaactttgtcttcattaggaaatttatttcaatagcgtcaagacatcaaataatttatgtatttggtgtccatttttataaagatacatgaaatatatgagaaggttaagaagaggtaaaggaggttaaggaacctcatcggctccattatatttggaagttgtgacctgtgttaaagcattgactatcactgtttatatttatcataatttggcatgcaaaaatgagagtcacaatttcagccacttgcattaattttacttctaagagattgaattttataatagagtcgggtagttattacataaaaagttttgcgttattccttttcaactttgagtttaatacattaaaacaattaattcagaagttgatacgagactgttcaaaatatctgtttgagtgtggacacttcttaaatgacaaaagcacagttaaaagatttattgattgagaagtgtaatggagttgaacactatgaagataaatttgtaatatttcataattactccaccaactggtagaacaaataatggatgcttttacaaaatagataacttgtactgtacgtgatatcataagatatctgaagacgcttcaaccaattttgacaagaaagatctgaagacgcttcaaccaattttgacaaggctaagataagctattttaagacaagagcgataagctatggctactatattaataaataaattatggtaggcaaggcaatgacctgagttgtttgcagtgttgttgagtagtatcactagggcatggtctttaatgtttacacagaaagaaaatttgtcacaatcggtgatcctgtaatcagttgtcctgtatatgggatcgtccagaacacattctcttcagagcggggcatacagaacggcgtggcttgctggggcttatttggagtctgaattgaagtcatggaaaaaatataaattcgaaggtttgataacctaataaccaaactctgtaatctaatatgatctgtatgaacagagctggctgttgaaactgaatagaaaagagaatgggacctttaaaacacaacttgatatctgaggggttaattctaaactcttcgtcaaagagagattcgtttttctgctgtttggccccaagattggcaactggataggcattggaattgaggaggaatactgttatatcaatagataagtcaaaagatctgcagagatttgtacaaaccttcttatcataacatgatgtatttgtactttaggagaaacaacaacatacatagatgtgaggctagaggattattgtatcttacattgtctgtataattcattacaggtatcaaatatgtgtcaatctcccagttccatcacaggtgcaatgataaaatacagtagttggtcaaatgatcatttttcctctcaatgtgaccatgtttattttcagatttgttaacaaattaagagttggttgatccaaaagaaagtctgcattgggtgagcttctcagccagtacatagagaagtgtgagatgacacacactagtttgctataccaggaaacctctgtttcctgttctagggcagcagtagcagcagcacatggcccagtaattcttctctcaccatgccaggttcacttcacagtacagagtcctgaaaataaagaagaaaatttttttttatctagaaaaagaaccaaacatgtcactttctagcctgctgaaggtggtcacagcttcactgtggctaggtatgggtggcccagtgggaatggactttctgtatgaactaaggactttggaagtatctttatggaaactttgggaaggaggggtaatggggtacaaaaattgaatttctttgtcccaatccactttatccttaaaccttcaaattctatcttttttccttcaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagagagggcacagtgacagaactgtcggagggaggtgtacaaaagccctggggacctgcttgagacctccacctgctggagaaccaaggcgggaaatcaacatcacagacaggaagtggctacagctgtggcagcccagatgcagtgttgtaggaaatacacttaactctaagaaaatacctctttaagttcatagaccatgatcaaagttatcattaactaaaaactttcttatccctgaatctttggtttaaagtttagacataccaaatttgtgactgaagattgaagagaaaaaactgccacaataaacaatttgccatttggctactaaattgaactggattcaaaaacatgtgactgaaaaatcatttaaaatatctgtgaattttcatatcaatttgttcagtaaatactggagatctaaaaaaagttcatgaaaaatacgtattataaaaactatttttggatttcaatttttttttgcaccaaaataaacttacacttaaattgctataacatatgtagacaggatctactttgaggcactaagaaaaataggacagcaatttgaaaagaacccctattagagcaacagattctgctaaaatgaagcaaaggaaagcttcacatttatggtgaaggttgggtagtagaatggtgaaatcatcaattctctatgaaactttacgaagtcagtgctccaaataaatcagcagttagcaagtggataactcattttaagaagggatgagacaatgttgaaggtaaatcctgcagtggtagaccatccacaccaatttgtttggaaaaagttaaccttatttgtgccctaattgaaatggactgatgattaacagcagaaacaatagccaacaccacagacacctcaatcggcccagcttacacaattttgactgaaaattaaagttgagcaaactttccattccatgggtgccaaaactattggacctagatcagttgcagacaagatcagagctttcaataaaaattttaagcaagtgggatcaagcccctgaagcatttctttgaagagctgtaacaagagataaagcatggctttaccagtataattctgaaggcaatgcacaatcaaaacaatggctaccaagaggtggaagtggtccagtcaaagcaaaagtggaccagtaaagtgcaaaaattatggcaatagttttttgggatgctcaaggaattttgcttgttagctttctggagggccaaagagcaaaaacatttgcttattatgagcatgttttgagatatgtagccaaaactttaggagataaatgcctaggaaagctccaccagagatttcttcttcaccatgacaatgatcctgctcactcctctcatcaaacaagggcaattttgtaagagtattgatggaaaatcgttaggcatctacatagccttgatttggctccttggacctctttttgtttcttaatgttaaaaaaatctttaaaaggcacccattttcttcagttagtaatgtaaaaatgaactcattgacataattaaattcccaggaccctcaattatgcagcaatggaccaaatggctagtatcactgcttacaaaagtgttttgagctcaatggagcttatttcaggaataaggtttatattttttattttgattttactttacacgaaccttttgaaatgtccttgtatttattgtgttatagacattattttaaataggaaaggcattgaaatcttttatatttcccttctaaatatattatgttgtttatattgtttaatggattaatttgatttaggtttgtttgctgtgagtaaatggtacttaaacatttattttctaaaggtgtctactatgtgctaagagctcctttcatcttattaacaccttgaatgtggaagaaatcagtctccatactacagatttacctgcctctcaacattcctatccacgaagtgatcattatttagtggcttccagaaggacatgtggagaatgttcctcacagaggcacaaaccttttcatttatatattaataagacatcttttcttctaaaatgaatcaccatttttgaaatatatgaaatttccctttccctataatgtttccacatggtttatttcgttccactgatctatttgtttcactctatgacaatctcagaatgtagttttatagtaaattttataatctcttagggtaaatcacttttcaccaaaaatctttttcaagattttaaaaaataattcttgcacatttacttttcagtatgttaaaagttctgtcacattttcctcatgttcaatacccttctattaaactgacaaaacaaaaatgtctaaaaaccagacagttgaaattgcatttaatgaatatgttaacaaatatcaacttgttttcgtatgtttttattcagtaaaatgatattttttctaattgtaaaggatcttttatgttctctattacattgtgaagtttcttacttttatcttcatatggatttgtatataactgttcccacacatccatctatatatatgcattttaaatgaaattatcttttatatattcatttttactgatattcccagtacaaacaaatgctatttaaaaatcatcttggttatatagctaagagtttctaactttaaagtacagataatttgcaatatattcatactacttgaaccattaaagtttattttatgaacctagactaacctcaacccaacacctaaaaaatagcatgataaaaatatttactctccaatttttttttttaagacagagtctcgctctgttgctcagactggagtgcagtgccactatctcggcttactgcatcctttgcctcctgggttcaagcgattctcctgcctcagcttcctgagtagctgggattacaggcgtgcaccaccaccacacccggctagtttttgtatttttagtagagatggggtttcaccctgttggtcaggctggtctcaaacttctgaccttgtgatctacccgcctcagcctcccaaagttctgggattacaggcttgagccaccaagcccagcctactctcctattaaaaagtcaagaaacaacagatgctggcgaggctgcggagaaataggaatgcttttacactcttggtgggaacgcaaattagttcaaccattgtggaagacaatgtggagattcctcaaagacctacagccagaaataccatttgacccagcaatctcattactgggtatatacccaaaggaatataaatcattctattataaagatacctgtacctgcatgttcattggagcactattcacaatagcaaagatgtacaatcaacccaaaagcccatcgatgatagactggatgaagaaaatgtggttcatatacaccatggatactatgcagcaataaaaataaatgagatcatgtcctttgcagggacatggatgggggtagaagccattatcctcagccaactaacacaggaacagaaaatcaagcacctcatgttctcacttataagtgggagctgaacagtgagaacacacggacacaggaaggggaacaacacacactggggcctgttggggagggaggcggagggaaagcatcaagataaatagctaatgcgtgtgaggcttaatacctagataatgggttgataggtgcagcaaaccaccatggtacacgtttacctatgtagcaaatctgcatattctgaatatgtatccaagaacttaaaagaacatatttaaaattcattgaagaaattgaacatatatttgcaagtgtcccatgccaatataaaacacattataataagcatgtatacatcttattaaatcagaatgaatatccatatattcatattcatataacttgataaaaaatagcagttggatacatagtattaatttaaaaattctagttttaaaatttataattttagatttttaatttaaattttaaatttcaaatttttaaaatacctcattttatttctgatgtctggaatcttatttagttgaaaatgtctctttgaattctctgagtaccatgagcttgtatagcttatgctgctgcctctaatgtagctgctattgttttcaatatggaatgaacaaggtgattggatttcttgaaccacttactataatagaacctctagatatttctaccaaataaagagtagagaacaaattaaaatacgccaaatgtatttttacagctactttcacatctattagatggagtctttcatagacattttatgaaagagtttcataatcctcacacttgttacaacgtacagtctaaacaggcaagatctattcactctaacataatatctaagggatggtgtgaaggatattgcaagcatatacacacacacgcacacacactcacatctcaccacaagttagagtttacagatagcggtttacctttgaggtagttagagagaaccagtaaagaagtcacacatattcagcctaataagtaattagttcaaatctaatagaaatgacatctaaaattggaatcttagaaacaagactctactaaaagataactttggaatgcaccaaaaatcagttttttaattgagaaatattgcctttcactaactcttcagtcattatcattgtatttcttggcatctacatctgggaaaacctttgtaaccacaggtaaaatgtaatatggaaatggtcactctaccttagtttaataaatgtattcaattgttttagtgacagaaaatttactcttgaatagagatgcaaatatttaaattaagtaattaaaacccagaaggcagtgtattaacaaaataatgcagcttgatttttaaaaagttattattattattattttttttattattatactttaagttttagggtacatgtgcacattgtgcaggttagttacatatgtatacatgtgccatgctggtgcgctgcacccactaacttgtcatctagcattaggtatatctcccagtgctatccctccccccttcccccaccccaccacagtccctagagtgtgatattccccttcctgtaaagttatttattcacttatatatccatttatttttaaaaaatcattcagcacctacagagtgacaaactttgtgctgagaactcagtccatttaacaatcttattgcaatctctagcatgtaatagctcaatttctatactgtaggtttacctgccccataccagatttatccataaaatgattaataaattagtggctcttagagggacattgtagagaggcagaatttgaagtctttcttttctctgcttttgtgcttcattttacccctctttcaaaaacatttaatgccatcatgtggatcaactttgcacacccccagacctgttccaccatccaaaatcctcattcttttcaatcttctccttctacctccaacaccattttctccttccctaagctttgaatggtaatggttggttggtaagtgatcttgtattgtaacatcctcttgtatttgcatttgaaaagtagatgtgtatagtataaatcttaaagagaaatatgtttaaaaatttttaaaattatttttaattgtggaaaaatatatataacataaattttgccatgttaaccatttacaaatggacacttcagtagtgttaagtacattcctttgttgtgcaaccatcactaccatccatcttgagaactcttttcattttggaaacctgaaactctgtgactactaaacaatagctctctattttcttctccacctaatccctagaaaccagccttcctttctgtctttataagtttgactactctaggtactttgtataactagagtcatacaatttttttttgtgactgccttatttcacttagcgtaatgtcctcaaagttcattcatgtcatagtatgaagcaggctttcagaatttccttcctttataaggctgcatattattcaattgtgtgtacataccctattttgttaaactatttatctatcaatggaaatttgagctgtttctatcttttggctattgtgaataagctgctctcaacaagagtatgcaaacgtctcaatatttggggtatatcccccaattctttcaactttagaagtgatatacccagaagtgcaattgctgaatcacataataattctatttttaattttttaaagaactgccaaactggtttccacagtggctgctgtaccattttacattttcaccaacaggacacaggtgttttgatttctccacatttcatcagcacttcttttactatcattatttttgatatgaatagtagccatcctaatgggcatgaagtagtatgtcattatgatttttatttgcatttccctaataattcgtgatgatgagtatcttttcctgtgcttattggccaattgtatatcttccttggaaaaatgcctattcaactactttgcccattttgaaatggggtgtctgtctttctctctctctctttctctctttctttctttcaagatggtgtttcaccatgttgcccaggctggttttgaactcccgagctaaagcaattcacctacctcggcctccaaagtcctgggattacagatgtgagccaccgcgcctggcctgggttgtcttttttttctgctgagttgtaagagttctttatatattctggatattgatcttttgtcggatatatgatttgatatttttttttccattccatgggttgtttatccactctgtcactccattaattgtgccctttgatgcacagtagtttttaattttgatgtagtcaagtttatctaagttttcttttgcatcctatgcttttggtattatagccaagaaattattgccaattccatgctttctgaaggctgaaaaaaaagaaaaaaagaaaaagaaattattgccaaatctaaatcgcgatgcttttcctgtaagataagagtgcagtttcactcttttgcatgtggatatccagtttttcccaacactgtttgttgaaaagactttcctttcacccttaaacagtcttaggaccctttcctaaaataatttggttgtaaatgtgaaggtttaattttgggctctctattgtattgcattggtctatatgactgtcattatgcaagcaccacacagcttttgctatattactgtagctttgtaatcagctttgaaatcaggaagtgttagaccttccaaacttgttccttttcaagattattttggctatttggggtttcacaagctgccatatgaacttttggatggatttttctattactgcaaaaacactattgggattttgatagggattgaattgaatctgtagattgcttttggtagcatcgacattttaatgatgttaaattctccaatccataaatatcagatgtctttcaacttatttgtgccttatttaatttatttcagcaacatttttgttttcattgtgcaagtctttagcattgttgtttaagtttattcctaagtattttattctttttgatgctattgcaaatggaattattttcttaatttccaaagtgttcattgttagtttatagaaatgcaattgatttttgtgtgctgtttctgtatccttcaagtttgttgaattcatttattagttctaactacaagcatatttaatggtggaatttcaggtgttgtgacagcagattggagaacaggacatttgtctcatgtccctcaggataactcatgtaggctgcaaaacttcaagcatacatagaagcatcaacttcataatgtaatcattttatatctttaatacatcaggcccttcaaaatttagtttaaatgttgagaagtcaaagaatgatgtccttctaagaataaatattctaacacatgatgatgtgctgaacaagatgaagaatttgtatttggatacatatttttaaagcaatgtttagttagtaattgaaaatactaaaccaggagaaaataatgtgcactctggtttccatactagagagatatagaagcagaaagttttacctcagtccacagatctagtaaataaacatccaacacttaaacttgggtcatttgactccaattgatgaattttcagcaaacaatgaaatataaaagtaagccaattcaatatacaactccagaagttataaaattaacagtaaaataaaatggttgagagtagattgaaggaattaaaaataaaagcaagaaattaatggctcaaaggaaaataacaaaatcaatgataaaaccacaacatgatattttgaaaataattacaatactaacatgatccagaaaaaaaaagtgagaagggacaaatgcatgcacaaaaaaaaacaacataattaagttgaatttattttgggaatgtaaagatgatttaatacttgaaaatctattaatataatgcttgaaattaacaaactttaagaaggccaaagatgttctaatgcctggtttggtggattgtttcatttggatctaggatgattcactgtacctgtgcatttgtgcaagctcatttaatttggttggctcttaaaaatattcggattctttctcttaatttgaccccaattatagatatagtgttattgttcttaaatttcttgttgcatttagattatttctatgaagaaaggggaaaatgataaatttattcaatcatatttatgacaaagttttggcttccatattattgtttttgtatttttcttttattgtgaagtgtaccaagttttattttagaaattgctggaccagtaaatattgttcaagttgatgggttgtatagacttcagatttttggaatgttcttgaaaattattcccatttatgtccttaaaccttgcataatcttgtgaaataatgcttcataacaatgactgactgtgcacagattaaacaatgctttaaataatgttagtcattaggaagaattaagctatgatcctgtatgtgagaaattttcatactggttaatttgaacaactatgctttagactcctttatcacaagcaagtttccaggaacagaaagagagtggtcactggccatgaataaagttccagtactctggtggttcacagaagtttaggaactttttcagccttgctaccatgcattgctcatcaggtgtttaataattggtctgaaaggaatgcttatgccactacctggtggtcagctcctaaactgcagtttattcatcctttaaaatatgttttctttcctcttttagtcaaagaatgagacctgaaattatttaattattttaaaaaatttcatttggataaatagagcacctattaacttgctgtcttaaaatatttcaagggcttgggaaaaagtcacgttggtgtcttctaacttctctctgaaatttctctgaaagcaatttatactggaaaaaatagggaacacatgttttgctattaatgagatttatgttcaaaactattaactttgccatgtacttacttgctgaatacttttgtgttttgttacattttttttgtaaagtgtgatagtgatagcttctttagtatttgttgtgagaattcatcaataatgtatcaaagaagattaacaagtagcagatgatctaacaatgagaatattctcaatagacccagaaaaggcatgtgacaaaatccagcatccattcctgattaaaaactctctctaaatgagaaattaaaaggaactttctcaacttaatataggaaacttacaacaacctatgtcaagtgtcatacttggtgaaaaactaaaggcttctccctaagatcacacataagaaaaaagttattgctctcactgtttctgtttaatattgtactagaatgtctatccagtgcaataaggcaagagacagaaacaaaaggcatacagtttggaaaggaagaaataaatcaagctttatttgcagacaacataattgtttaagtagaaaatccaaagaatctgcagaaaatataccagaacaaataagtaagattgtaaaggttgcaggataaatgatcagtttgcaaagattaattgtatttatatattttcacatgcgacaatcagaaattaaaaataaaaacacaataccatttacaatagcatcaaaaatattaaatgcttacagataaatcttacaaagtatagaagacttggtaacttaaagccacaaaacctcatgagagaaattaagacctaaggaatggagagataaactatgttcatagattgatagactcaatattgttaaaaagtcagttctgtttcaattattctacagattcaatataaccacaataaaagttctgtcatttttttggttaaaattagcaggctcattataaaatttactcagaaatataaggcacctagagtagccaaaacagggttggaaaagaaaaaatttggagggataatattatcttacttcaagttgttttccacagtaatcaaaacagtgtggcatttgtatacagatagactaacagattaatagaacagaatagagcccaggaatagacccatatatacatgaacaactactttttgacaaaggtgcaaaggcaattcaatgtggaaaggatagtcttttcaacaaatagtgcttaaataattgaatatccatatacaaaaaaatgaactttgacactctcataccatatacaaaaagttacttaaagtgatcataaacataaatgtaaaaccccaaatcataacacttcaagaagaaaataggaggaaatttttgtgaccttggcctatgcaaacatttcttagatatgatagcaaaacatgacccataaaagacaaaaagttgataaattgaaaaattggttttcattacaacttaaaactgcctctggaaacaattctgtcaacagaattaatagatgagctatagactggaaaaatacttgcaaattgggtatctgagaaagtcatttatttgagttatgcaaagaacccacagaacccattaacaaaaaaaaatagaaaagtaaataaaatgggcaaaagatttgaacaaacacttcagcaaagaaactatatgaatggcaaataggcatatgaaaacatgcttagcatcattagtcattagggatatgcaaattaaaatcacaattaggtactactgcatacctattagagtggggttgacaaggatgtggagcaactgcaactctcaggtactactggtggaaatacaaagtaatataataactttggaaaataattgggcaggttttaaataagtcaaatatacacctgatatcagatgcagccattctactccaagttatttgctctaagagaaatgacagaatacacctatacaaaatcttgaatacacgtttgtagtaactttatttgtaacagcctcaaactgggactaactgaaatgtacatcaacagataaataacaaacacattgttttatatctatataatgtaatagtactactcagcaataaaaagaaataaaccattgtttcaaatgacaccatgaaagaatctcaaaataattatgctaagtgaaagaagataaaccaaaaaaattgtatatgatttaatttgtataaattataaaatacacaaactaatatatagtgacagagaattgcttggaaatgggcatgggagataggaaggttaagagaaaaagtacaaagaaatatgagaaacttttggggtgatgtaaatattcatcatgttgattgccataatagcatcacaagcctatatgtatgtcaaatcttataaaaatgttcactttactttggtgcagttaatttttatgtcaattatacatcaataaaaccatttaaaaatccaatttaaaagtacatgtcttcaacatcacagaagtattctgatatggtccaagatgcaaactgttctcactgggtttaaactatttttcttaagtatggatgacaacagtctacacccatgtgctctactgtttattttcaacccagcatcattccagcttattttgcattcccctttgtatatcagaatagaaatttgtagctgattttccagaattcattttcaacatagttctaggcttgtttctgacaaagtgatttggaaggtggaggagaaggagaagagatttgcaaacccaaacaatatctgggcctgaatttcttaatgaagtctgtatctgagaaactattcatatgctgactctggacgcattctttatctgaatctggggagagtgaactccaggaaacagactgaactaagtgtctgttcttagctatgtgtctaggtataaatgtttacaggtccttgcagaaagttagatccttctcccaaattttactctgataacacttctggaggttttttcttttctttttcattttatttttagatttacatgcggaggtttgtaacaagagtatgctgcgtgatgctgaggtttgggctcctagttggtcacccagatagtgaacatagtacgcaacaggcagtcacctggatagtgaacatggtacccaataggatgtttttcagcccctcccccctccatctctccctccttttggagtccacgatgtctattattcccatctttatgtctgtgtgtgcccacagtctggcttccacttacaatgagaacatatgatattttgttttctgtttctgcactaattctgcacttaagataatggcctctagctgcatacatgtttctgcaaaggatataatttcattcgttttatggctgcatagaattccatggtgtatatgtaccaaattttccatagtctatcacaattgatgggcacctaggttgtttccatgtctttgctattgtaaatagtgctgtgataaatatatgagtgcatgtgtcttttggtagaatgatttatattcctttggatatatagccaggtatgggattgctggcttgaatcataaatgtttttttagttttctgagaaatctccacactgctttccacagggctgaactaatttgcattctcagcaacagtgtataagcattccattttccctgcaaactctccagcatctgttattttttgaattttaataatagctattctgaccggtatgagatggtatctcattgtgattttgatttgcatttctttgatgattagtgatatgaaagattttttcatatgcttgttggccacttgtatgtcttctgctgacgggtgtctgttcaagttctttgtccgttgtttaatggaattatttgtttatttcctgttgatttcttaaagttcactacagattctggatattagtcctatgtaggacgtatagtttgcaaataatttctcccattttgtaagttgtcttttaactatgttgatagtttcttttgctgtgcagaagccttttagattaaataagtcccacttgccaatttttgtttttgttgcaattgcttttgagaacttagccaaaaattctttgcctaggctgatatccagaagtgcgtttcctaggttttcttttaggatttctatgaggtgttacatttaagccttcaatccctcttgaattaatttttgtatatggtgacagataggggtccagttttattcatctgcatatgtctaggcagttatcccagcaccatttgttgaatgagtcctttccccattgcttatttttgttggctttgtcaaagatcagatgatcataagtgtatggctttatttctcggttctctattctgttccatgggtctttgtgtccgtttctggaccattactaaggccaagttttagttacttagccttgtactacaatttgaatttgggtaatgtgatgtctctagttttgttctttctttttgttaaggattgctttggctattcaggctcttttttggttccatatgaattctagaatggtttctactaattctgtgaaaaatgactttgacaatttgataggaatagttttgaatttgtagattgctttgggcagtatggacattttgacgacattgattcttccaatccataagcatggaatgtttttccatttgttcgtgtggtctatgatttctttcagctgtgttttacagttcttctttcacctctttggttagctgtattcctaggtatttgggggcatgtggctattgtaaattggattgcattcttgaactgactctcagtatgatcactattggtttatagaaatgctcctgattttttaatgttgattttgtaccttgaaacttcgctgaagtcattcattagttctggagtcttttggtggagtctttagtgttttctaggtatagaatcatattgtcagtgaagagagataatgtaacttcttctttccctatttggaggccttttacttctttcttttgcctgcttgctctgggtaagacttctagtactatgctgaatgggagtacagagagtaggcattcttgtcttgttcccgttctcaaggtgaacgcttccagcttttgcccattaagtatgatattggctatgggtttgtcatagaccactcttattattttgaggtatattccttcaatacttagtttgttgagggtttttatcgtgaagagttattggattttatggagtgctttttctgtatctattgagatgatcacatgggttttggttttaattctgcttatgtggtgaatcgcatttactgatttgtgtgtgttgaaacaactttggatcccaggaatgaagcctacttgatcccaggaatgaagattagctttttgctgtgctgctggattcaggatgctagtttttgttgagaatttttgtgtctatgtgcatcagggatttgatctttagttttcttttatcattgtgtctttaacagatttttggtatcaggataatactggatttgtagaacaatttagggaagaatctcttcttgattttttggaatagtttcagcatgattggtatcagttctttgtatgtctggtagaagtcggctgtgaatccgtctggtatgtggcttttttattggtacattttttattactgataagctgcacttcactaaaatttaaaagttacgctcttatgaaatgcaatgtcaagaaaatgggagacaaaatgcaaactgagtaatccattgcacttgaacaaatctttcttgatattttagtttctctccatgtaagagacatatttcagctgcatttagtctgccatcttaccaaaaacaggtttttgttttcttttgttatgttataaaatgaaaactcacaggaagtaagcataatgaagtgtttgtttttactgcagacacttcataggaaaagaccagctttaataatctgtgtaatcatggggacatttttttgtgatgacctcagagtgttatctctgatagttgataaccgtcttggtataggacagtgttcacaaataaaatcttgtaaacaactatcaggctggcagcaacaaaaccatcagggaagtttttaaaaaatgaaaccctttgaatcttggaaattgtggtttgaaatgttggaaatcgtgattcctaaagttagtagtcttgtcccaacatctgtaattttaaatgactcacaagttaattcagttctcacacaaccaggttttagaacctcgattatcagccgatgtatctttatcaatttgtaaagcaagagaagaggaaagttctaactcatgcttcagtctgttgatgcaaatctacatgtggattccctacatcatcagaggaaattgattaaactttggcaataaaatgttggcatatgaccacagtagaaagcgtccttgaggccagatctccagattatagggttaacacttgttgcctgattgtcataagcaagcaacttgtcttggagtcattgaaatcgtgagggaataagctattaatctgaggtcatatcttatcagtaaatgtcagtcactgctctacatgttaggatacagtgctgaaaaacatagactcagtaacagcaagacttcttaacattccctctgatttcaactcaaaacccttgtctgacatcccattgaattataccactggcctgcaatggatacgtaaaaatattggcctgtattaaaatatccaagaaaatggaactctcacctacagaaatactctaggatgctttgctaaagatcttttgtttcaggtagtgtccaaagaacaaaattgacaaaatagaccatagagatgacaacatctgcccttcatatttacaaggaccacctgagactggcatgggccttataaatgaggtcagggttgaggacctatttctgacttttggaaggagtccaggaaaacattcatcccagttcagcccctgtccaccagagggagtggcttcctaacacaaactcatttcctgctatcactgtaggtttcactgtgatttcttcatgttaaggatcaagaccattatttgggtaacacactaaagatgaactattctccaggcttagtatctctgatactcttactgcttggttagtgagatgccttttaaaatttggtctctgtcttctatcaagccaaaaaaatctttaaccataatttgacctaagagcattatgctcaaggctaaacagatctctctctctctctttttttttttttccctaggaagaacccgtggagattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctgagtgacacagtgacagggactgcagggggagctgagcacaaactctgagcagcacggggggcccggctgctgagtgtcagccactgtgatccactctggttctagcacagtctgtggttgtttgtgcctcagtttctctgattgatgcagtaatcatacacatggccagaggagaaaaacaagaaatgaacatccccaaacccagctcttggttagtgaaattaaaaacagacattgacaccaaatagttcctcatccagtgccaaagtaatttcaaggttaaaccacagaaacaatgaagctgtctctgtgatcatccttgcagacaaagttcaacccccacctcttgttccaggtcactctggtagatattggaggtggatgtgttctattacatttttacagagccaaatatgccagagaaggtggcgtctgtacaatgtctctgtaacagagtacagcaggagagatgacgtgagagccacagctcctcaattcagttcaaatgtctatgcaggattcttaatagagaaagaagggaagagaagaaaggaggagggacagaatgtcacatgtaaaaaaataatacggagaagaaagcaacaattgtcagagagagggaagttttcttttttggtaagccagatggtagacaaaggctgatgttccaaaaagaaagggaaggatcaaaatcattattgaagaaatgactcatttgtaaatcataagtattccttgcttgttacattgatcaattggctttctaacaacaagtccttaagtgagttagttttgcagtgccaatggaagattaagcatacagatttatatttgtatccctgtgaaatcctattaaagacacagtaaagaaattgaaaagggcataaaaccacaaaaagaatagaaaaggaggtgacagcagatggtgataccaatacaattttagaaggcaggagtgtatggagaaatgaaaacttgcatagcagaccagataaagaagaaacctgggcccagtgaaagaagacaacaaggaacaccaatgtgtgttgagcctttgtggaaaggtttagaaatcagaagtaccaatgacctttgaataattggtgaagataatgctttgtgtgtgtgtttctattttgagggtatttgaaaagagggtatgaaaagaggaggagaaagtgagaaaatgtataattaattgaccacccatgctctccaccactgcatgtataacaagcaatgctcacttcccaaacccagaagaaagctggaatttaatatttcatgaattgaagtgcagaacacaataacacaagaaagcagaataaaattaaaatgtaaaaatataatagtcaattatttaatataagaaatataaaatattgtttatgaaatattctcgtagtagtctatgtgtttcaacccaattgtcttctagataagtttcactaatttatactatcagtagtggtgatttggcaggatacctattttccttaaaccttatgtattactaaactttttgacattggcttatgagttagaatttcatttaaagaatatttcatttatttatgaattagatggagcgtcatttaatatacttaaaagctatttacattttttgatatattgccatttatatatctgcccccccttttttttttaccatttattgtctttattttccacatctaccattgttccaactatgagatactggcaaaccctcaccctttgaaaaattctttattttttaagagcagttttagtttacagcaagattgagagaagggtacagagatttgccacacaccctctatcccttcccagatatatatcctctcccattatcaacatccaccaccagagtggtacatttgttacaaatgatgcacttacattgacatgtcatagtcactcaaagttcatagtttacattagggttcacgcttagtgttgcataatatatagatgtggacaaatgtgtaatgccatacatctatcattgtagtatcagacagagtaatttcactgtcctaaaagtcccttgtgctctggtattcattcatttcccaatataacccctggctacctctgatcttttagtgtttccatgattttgccttttccagaatgtcatatacttggcatcatacagtatgtagactttccacactgacttctttcacttagtaacatggatttaaggtttctgtttctttcatgtcttgatagctcatttttttttagtattgaataatattctattttctggatacatcatagtttatttatccattcttcttctgaagggtattttggttgcttcgaagttttggcaattatgaataaagctgccacaaatatccctttggaggtttttgtgtagacgtgttttccactacttggataaataccaatgaggaaaactgctggatcatatggaaagaattttttttttttttaaaagctgccaaactgtgctcaaagtggctgttccattttgcattcccaccaacaatgaatgagagttcttttttgtttatatccttgctagcatttggtgttgtcagaggtctggatgttggccattcaaataggtgtatcatggtatctcattgttgttttaattttcatttccctgatgccatatgatatagaacaacttttcatgtgcttatttgctatttatatattttctttgctgaaatatgtgttaaagtcttttatccatttttttttggtcagactgttttcttattgttgaattttaagatgttttgcataacagttcttgatcagatatgccttttgcaaatattttctcctcgtctgtgttttgtctcccattttcttgacattgcatttcataagagcataactgttaaattttggtgaagtgcagcttatcaataattttttttccagagaacatacctttgtctttgtataagtcgttgccaaacccaaggtcatctagattttctcctacattgccttcttggagttgagttttgttttgcattttacatttacatctatggttgctttttgagttaatttttgtgaatagtataaggtctgtgtctagagtctagattaattttcttttctttttctttttctttttttttttgcctgtgaatgtccagttgttccagcaccatttattgacaaaactgtctttacttcattgtattgcctgtgctcctttgtcaaagattagttaactacatttatgtgcgtctagttctgggttctctattttgttccattgatctatttgtttattcttttgccaatgtcacagtgtcttgattattctagctttacagtaagtcttaaaatcaggtattgtcattcatctgactttattctcctgtaaaacctttttttgttttgataattctgggtcctttgcacctccatataacctttagaatgagtttatcaatattcacaaaaaattgctgggattttaattgagattgcattgaacctacagattaaactgtgaggaatgaacattttgacaatattgagtcttcctactcatgcacatgtcatctgggaacaaagttatacttctttttttcctaatctgtatactttttttttttttacttgtcttgttgcattagctaggactcgcaatatgacgctgaaaaggagtggagagaggcccatctttgccttgttcctgatgttagtaggaaagcatcagtttctcataattatgatgttagctatagattttggaacatattacttatgaagttgaaggaattccactctatttctagttcaccgagagtttttatcatgaatgggtgatgaattttgttaaatgctttttctgcatttattgataaaatcatgtgatttttctagagacttgaaaagttgagaagtttatagccgatagacacagactcattaaaagactgagaacaaattgtgggcctatagaacacttcctctcccctcacaccttaccaccatagcactaacagcctatttacagcggttccttttaccaagtatgtcatgtctggctatcaaataaaaaattacagggcgtattaaaagggaaaatacaattgaaagagacagaaaaatcatcagaaaaacacatcagggttgttggaactatcagacccaggaatttgaaacaaatatgccaacggctctagtaatgaagtagagagcatgccagaacagatgggcaatgtaacagagagaccgaccttctaagaaagaaccaagagaaaaaaaaagctagagatcaaaatacagcaacagaaatgaagaatgtcgttggctgacttattaataaactggacgtagctgaggaaagaatttctgaacttaaggatatatcagcagaaacatccaaaactgaaaaagtagagaaaacaaagactaaaaaacacccaggaaagagtatctaaaaatattcaaaaactgtggaacaactatagaagtatactatacatgtaatgggaatgtcacagggagaagaaagagagaaattaacagaaaacatatttaaaacaatgatggagaatttctcccaaaataatgccagatgccaaaccacagatctaagaagctcagagaacacttggtagcataaatgccaaccccctccaaatcctaagcatatcattttcaaactagaaaatcatagacaaagaaaacatcctgaaagaagctggcaaggggtggagtgggggaagtgccttacctatacaggaacaaacacaagaattacatccaacttctcttcagaaatcatgcaaggaggagaaagtatagtgaaatatttaaggtattaacagaacaaaccaccaacctagaattgtgtacccagagaaattatccctcaaaagtgcaagagaaataaagacattttcagacaaaaattggggatacgtgttgccaactagccctgccttgcaagaaatgttaaaagttctttaaagataaattaaaagttcaggtttcttctatggcagagttgtgtaaatatgaatacattcaaaatataaatgtataaataaagataaacctcaagtaagtctcagttcaactacagaaaaataagaaagtgcttttatgagatatttagctaaaagtgcaattcctgtttgtcttttgcacactagtggagactgtcccataaccagagaacccacttgcaaatttgaaaacctaattagcttccttctcagaaacactctgcttattcttacatttatcagcttctgagaacatgacagcaggtgtaagaagcttctccatcagtaatccaaactcggtgcctgtcattgtaaggaatatgcaactgatgctggagaccagggatttcattcctgcttttgcagggacgaagtgagcttgtgtagaccatgatctctctcctgaatctacgacaagaattctgctactgcttgatgaaaagggggtcactgagaactctggattttttaatgcttatttgattccaatgagggggcaagtaaaggcctgatggttgctctctctgaactcggtaaaacattgtaaaaatagtacatgaaaataaaataatacaattttattattgtcttgtaagtgtgcagaaaatgatactctgtcttagttttcccttagtcgtatcaaagtcttgaaaatttagcctttaccaaagcatttccttttccatctaggcataacacttctgctctaaactcatataaactattagaacattcctcaattaccacaaaaaatccttcaatttcctagtaattagtcacagaagaaagctattatgataaaaacagatggtatttgttctagcatataagtgaataatttatgtttcatgagagtagaagtcaagcatcaaatgatcaaagctgaatagaatttttagcagtaggtttttcgtatcctcctctccaaatttcatcctctcctttcttgaaggggttgacaaagacaaagtgtggcctgcctgtgttctctctcagctcagtcactttcacgtctttgaaaccaaataatgccatggggctgagtccttctcagctgaatccatgaaaaatagttcatcttttcacaaactggtaaacaagtgaagcatttcaattcacacattgggaatgtcaccatttaccatgtgatttgttgattagggaacaaaaaggagaggtggtgaagtgagcagttaagagtaagaatttaggagcctgtttgcctgggtttgaatctgatcttgaatgcttataactgtaaaatcttggctaagttgcttaactttctgactaccatttgttgtggggattaaatgaatatatatatttgaaattctggcccatgataagtgctcagtaattgttagctgattataaaagctgctataaaatcttctataatattgagaaactaagaagtcacttgtgttcagggagagaaaaattaccatttcggtagttaattatttagtaaataagcaagaaaagaagaatacatgttgacctaaaataataatgaagcccttatatgtacaatgtgctgtatcaggacatttgtctactgatagcagtataaattattgcttttacctggaaagaacttatcagaaaaaatttattccataaattgaggaacaagataaaatacataaaaacttaaccaattgttaaaattataagtatgtggacaattaagttttaaaggtattttcaggaggagatcactgtgttacagaaaagtcaaggagaggcatcatggggaaatagaaaatttaatcaggctttaaaggacagacacacatcaaatttgttcattatacaattatttcttaaataggcaacaggggtttttgtaggtttgatgaatagaataataaacaaaatagacaaagtcagacaccagaagagcttacctcatgaggctcgagtctagctttgtctacagtgttcaactttctcttacagaaatatcctatgaagttttcgttctaacatagatattgctcttgcttaccataataattggcctgttttatgtgatgattaaaaggtaaggtttttttgttttgtttttggaaacaggtatcactacgttgccaaggctggtcacaaactcctgggctcaagcgatccacctgtctcagccaactgagtagctgggactataggcccacactaccacacctggccaaggtctaagtatttaagtgctgtatctgtcacttactaaattatgtggccatggacaagtacttaatttagagcatctacacatcatcaattttaataacatacaacttaccacatgattgtaaagattgaattaaattaaatgaatttaattacatgattgaatttagtcaaaaataatttttcagctgatgatagttattctggaatgtggatgaaatgttgataaaacagaacataagataaaataactaaaaaatttaagtatagattaaggtttagctttccactctcctgctattgattatattattttactatggttaaggctgagtcaccctttatttcatattgaccttattccatccaattatttgaactgactgtaatggctttcttgtttggtttctttagttcacaggttttatgcacagaatgaaacattcttgcccctggtgtaacttaatgtaaattctaagatgaattcacatgagccttatggagcaggtgtcagatataatactattatattgagctatggtgccaataattagatccgtatctgggggctcatttaacaggtttctgcattgaaaggagagaaaataacctttctaggctttccttggggaggaatgctttttggatattcaatttatgacttgtacatacatggtagatgctcaggaaggattatagaagaaaaaaaggaaggacaacaatctggcagacaaacaagcatcactctccaacaaatcagcacctggtcctaccaaggtccttttccatgttacctcttcagacatcaggaggagctgtgttatctgtgcatgggggaatggatcttgtttgtggttggctgggaggactctcagcttcctgtaataacagaactatgaatattcactcagagaaacaagctattggcttggtagtgtttgagggctcccagaccccaaccagagtccgcagtaagtctcatggataaagtggagaagcccttgggagtttgtggagaagcccttgggagttttgttcttgattttctcttggcagctgtgctgtgagttttggggctctggaaatatcattgaaaagagcagtttgtagtatcttctttaaaagtctgcacttggacacaggaaggggagcataacacaccggggcctgttgtggggtggggggacggggtagggatagcattaggagatatacctaatgtaaatgactagttaatgggtgcagacaccaacatggcgcatgtatacgtatgtaacaaacctgcgcgttgtgcacatgtaccctagaacgtaaagtataataaaaataaataaataaataaataaataaataaataaaataaaagtctggaagttatagaagggtggttagggcctctgtgctcacctgtggggacttgaaaggagagtatatcttccaaaagtagtcagccatgaatgaatgtcctctgtctgtggttctctgtttaaacaggggtgaacagcctccatattctggagtagagtccttcattcattcctgagtatccgggagggaatgcacaacattcttaattgcacttatgaggagagaacgttctcttaacttctactggttctggcagggtctggaaaaggacttgtgtctttgaccttaattcaatcaagccagatggaggagggagacaaacattttaaagaagcgcttggaaaagagaagttttatagtgttttgaatatgctggtctctcatcctggagattcaggcacctacttctgtgctttgaggcacagggtccccaagcacctgcagcctgtaccacaacctgcatccgggacccttgacacagccttgccttgcaggtgggagtgaaggtgttgtctttatatgtagagagaacttctttataaactctgtctccaaacagaagcgaagggtagtgcagaatctttcttatgtgatgaagctgaatttatattaaattaaattgcattttgttattattgaaatttcattcttcaatgtagattgtgctgtgctggttctgggcctgtttgcccaccgatcccttccacagctctgtcctttactctaaagtcgcagaccactgtggcacaggctctgaggccaagaggcaagttttctccgtgctatactctcaccaacagtattttacccatttgcttgtaaattcatgatgtttcttgtatttgtatcatctatactattatttacttaattaaatgttaaattaacttttatgttgagtagacttcaaaactgtgtaaaatattgttcttattttaatggatactatcagtgaaattatattttatataaactatacatctgatgtgcaggctatgtttgttcctgatacaaactaaaataacattacatgtataacaattaaaaagaccatctgtgtactgcctaacatgacctcctatgttaaccacaatttagaaaatactgattcagctcatgtccctcatttaatagatgaaaaaagtagaatcaacagggacagcatcacttactcaaagcatgaattacagcaaaatggaagctaggaatggaacacagacattgtggccccttgtcacttgctttttccatgaaggatgtaaagtaggattcagtgtttgaaaaaaggagtggtatgttgtaattttaaactaaattatacttttattacttaattatatgttcattagaataaattaggagatataaacacccagaaaacatagaacactcctataatttcataacctagaaatgatagctattcacatgcaataaaatttttggtgcacatgtaaagctatatttttgtataaatgtggtttataatacatcaagtatttattagcacacttttctttcaactttatatttaggtattttcaactcaggaagcaaatattgaagaataattttaaattattgcctagtttccattacataaatatgcttttttaaaaactcttttttttggtattgtttctacttatacagtattacagataatgtttttattaacatcattaaaggtgtagttttaatggaagtgaagttgctggaataaagaaaaacacatgatactgaatcccttatttccatggagctatttctcaccaaactgtaatttcaacagtagcacatgatgatgctaattttccaatattttaccaattgtaaacattattattttagattagcttccattttgttaagtaaaatattgttttttattattcttttcttttaatttgtgattttatacctttgattattaaaataaataaataaaatgagatgagaaaacatcagatgccatcacacagaacaggtatcctttcatacagtaacatgtgttttttgaaagtgtgaaaaatactgctttggtccaagctaccttctaactggtctctcttttctcaaggcaatcaattctctatgtccttgctacttgaagtgtgagccagcattgtctgaacttgtactgattctcaggctctaccctaggctgattgaatttgaatctgcattttatcaagatttccaggcgattctatcacatcaaagtttaagaagcacccatctgatgagttgccagaatgattttttaaagtataaataaagagctttctccacttgtcaaacgtgcttcaatggctttctactgctcctggaataaagtgtggtggctttcaggctgtgatataaaaggatctatataattggaacctcccttggccctttggctttaaattctcttttcctggctctctgtgcagcaaaacttctgattctctttcccacatgtaggctctctttcatccatctgaaatgctctttccctaaatcttgttgagcctgactcaacaagagtcatccttcaggtctcagctcaaatgttactactgtagaagaaaaacctactgacctctgctactcttcctgactaatatatctgtctgtaatcctccccctaactctgtcagaacactctagttatttctcctatgttatttatcgtaacttacagttacatttttggtttatttgccagtatgttcattggccataccttctattagaatgcaatctttatgatatcaggggtattgttggtttagttcatggcttgattctttttgtttgtttttctttttttttttccaatttttattttaggttctgagggtacatgaaaaggtttgttatattggtaaattgcatgtcacagggacttggtggagagattattccatcacccaggtaatgagcatagtacttgataggtagtttttggatcttcaccctcttcctactctccacctccaagtaggccccagtgtctgttggttccttctttgtcttcatgtataatcaacgtttagctcccacttataagtgagaacatgcagtgtttcattttctgttcctgtattaatttgcttaggataatgccctttaactgtatcgatgttggtgcataggacatgatttcattcatttttatggctgcatagcattccatggtatatatgtaccacatttttttccagtacaccactgatacgcatctagattgtttccatatctttgctattgtgaatagtgctgcaatgaacatgtgtgtgcgagtgtctttatggtagaatgatttatatttctttgagtatatacccagtaataggattgatatgtctgatagtatttgttttatgttatttgataaatctccaaatggctttccacagtggctgaactaagttacattctcaccagtggtataaaagcattcccttttctccccaaccttgccagcatctgttattttttttactttttagtaatagcctttctgattggtatgagatggtatctcattgtggttttgatttgcatttatctaatgattaatgatgttgagcattttttatatgcttggtggttgtattgatgtcttcttttgagaagtatctgttcatgtcgttttcccattttgtctgttcatgttgtttgttttttgcttgttaatttgcttaagtttcttatagattctggatattacacctttgtctgatacatagtttgcaaatattttctcacattctgtaggttgcctgtttactctgttgatagtttcctttgctgtgtaaaagttctttagtgtaattaggtcgcatttgtcaatgtttgggtctttttgcaattgcttttggagtctttgtcatgaaatctttgcaaggcctccagaatataatttcataagttttcatctagggtttttatagttttaagttttacatttaaatctttatttagtccatcttgaatttatttttgtatatggtaaaacaaagagatccagtttcagtcttctgcatatggctagacagttacaccagtaccatttattgaataaggagtcctttactcattggttgtctttgttggctgtgtcgaagatcaggtgatcataggtgtgtggctttgtttatcggttctctattctgttccattggtttatgtgtcgatttttggattattaccaaggctaagttttggttacttagctttgtactagaatttcaagttgggtaatgtgatgtctccagttttgttccttcttttgttaaggattgctttggctgttcaggctcttttcttggttccatttgaattttagaatggtttctactaattcggtgagaaatgacaatgataatttgataggaatagtgttgaatctgtagattgctccgggctgtatggacattttgatgacactgattcttccaatctatgagcatgaaatgtgtttccatttgtttttgtggtctatgatttctttcagctgtgttttgtaattcctattttaggtatctttcacctccctggttagctgtattcctagataactttttttgtgtggctatagcgaacaggattgtattcttgattttgctctcagtttggaggttttcagtttatagaaatgctacttattcttgtacgttgattttatatcctaaaactttgctgaagttgtttattaggagccttttagcagaggccatgggttttctaggtaaaaagtcatatagtctgtgaggatagagattttgacttcctctcttcctatttggatgccatttatttctttctcttgcttgaatgttctggctaggatatccagtactatgttgaataggagtggtgagagtgagcatctttgtcatgtttttgttctcaaagggaatgcttccagcttttgcttgctcactataatattggctgtggatttgtcatagacggctcttattattttgagttatgtttcctcaatgcctactttgttgaggagttttaacctgaaaggattttgaatttcatcaaatgttttttatgtctattgaggtgataatgtagttttttttttttagttcagttcatgtaatgaatcacatttattgatttgtatatttaaacaaccttgcatttcagaaataaagactacttgattgtgctggattagctgcaggatttggtttggtagtattttgattaggatttttgcatgtgtattcatcagggatattggcctaaagttttcttcttttgttgtgtctcttctaggctttggtatcagaataatgctggcctcatagaatgaggtaaggaggagctcctattcctcaatattttggaatagtttcaaaaagtaccagctcttctttatatgtctggtagattttggctatgaatctttctagtccagggcttttttcttgttgtaggtttttattactaactcaatttcagaactccttattggtcagttcagaatattgatttcttcctgagtcaatcttgggaggttgtatttttccaggaatttatccatttcttctaggttttctggtttatctgcatagaggtgttcaaaatagtctctgagggttttttgtactgctcctgtgacatttctgattgtatttatttggatcttctctgtttttttctttattagtctagctatcagtctagcaatcatttttattctctcaaataaaaaccatttggttttattcatcttttgtatggtttttcatctccatttcattcagttcagctctaagtttgttatgtctcttcttctgccagctttggggtgggtttactcttgggtttttttagttactctagatgtgatgttaggttggtaatttgggatctttctaactttttgatgtggatgtttagcactatgaactttcttttcaacactattttagctgtgtctcagtgattctgttatgttgtatcttttttttcattagtttcaatgaatcccttgctttttccttagtttcactgtttactgaaaagtcattgaagagcaggttgtttaatttccacataattgtatggccttgagagatcctcttggtattgatttctatttttattgcagtatagtccaagagagtggttgatataatttggagtttttttgaattttttgagaattgctttatagtcaagcatgtggttgattttagagtgcagataagaagagtgtgtattctgaggttgttgggtggagtgtcctatagatgtctgttaggtccatttggtcatgtgtcgagtttacaacccaaatatctttgttatgtttctgcttcaataatctgtctaacactgtcagtggggagtttaagtctaccagtattattgcatggttatctaggtctcttcataggtctctaagaatttgctttatgaatctgggtgctccagtgttggatacatacttatttaagatagttaggtcatcttgttaaattgaacacttatcattattcattatttaatgcccttccttgtgctttttcatcattgtatttagaaagtctgttctaactgaaattagaaaaagtaacctctgctctttttggttttctatttactttgcagatttttcactgtctctttactttgagcctatgtgtgtcactgcttgtgaaatgggtctctaggagacagcatacagttgggtcttgcctctttatccaaattgctaccctctgccttttaaagtgggtcatttactctgttcatgtttaagtttaatatttatatgtgtggatttgaccctgtcttcgagttgttagctggttgttatgtagacctgattgtgcagtttcaccaggtgtggtgggtgatgcctgtaattccaacactttggcaggacaaggtgggcaaattgcatgagcccagtagtttgagaccagcctgggtaatatggcaaaaccctgtctctacaaaaaaataaaaaaatttagctgagtgtgatgctgtgtgcttatagtcccagcaggctgaggcaggaagattgattgagcctgaccagtcaatgctgcagtgagccatgattgtaccactgcactccagcctgggtgacagaatgagaccctgactcaagaagaaagaaagaaagaaggagagaaggagagaaacagagaaagaaagaaagaaggagagaaggagagaaacagagaaagaaagaaagaaggaagaaagaaagaaagatagatagatggtggagctgttttacagtgtcaatggtctgtcttaattgtgtttttgtggtggcttgtagcagtcttttttccccatgtttaagcattcctttagggacctcttataaggcaggcctggaggttacaaatttatttagcatttgcttgtctgaaaagaattttgtatttcctttgctgataaagcttagtgtggttggctatgaaattcttgtttggaatttattttctttaaggatgctgaatataagcccttaatctcctctggtttatgaggtttctactgaaaagttcactgttatcttgatggggtttccttagtagatgaccagccccttccctctagtggcctttaatattttttctttcccgttaaccttggagaatctaatgacgatgtgtcttggagatggttgtcttgtacaatgtcttgctggggctccctgagtatcctgaatttgaatgttgaccttcctagtgaggttgggaaaatttttatgggcaatattctcaaatatgtttcccaagttcctttctctttctctctctctttcagggatgccagtgaattataaatttggtgtctttacataatcccatatttttcagaaatttttgttcattattttttattcttttttctttatttttgtctgactgagttgattccaagaactattctttgacctctgagattctttcctcagcttgttgtattctcctgttaatacttaacaattgtattataaagttcttgtaatgagtttttcagctctatcagaacagtttggttctttcttaaaatggctattttgtctttcagatctcatattattttatttctttacattgtttagattccttggattgggtttcaattttcttatgaatctcaatgttcttacatccaaattgtgactgctctgtgtgtcatttcagccatttcagcctggttaacaaccattgcctgggagctagtgtggttgtttggaagtaagaagacactctagcttcttgaggtgccaaagttgtcgtgttggttatttatcatctgtgtaggctgatgatcctttaatatttgaagttcttgtcctttgaattttttttttacttttatattattttatgcccttgagggatttgactgtggaataagttgcgttcagtcaactggcttcatttctggatgatttcaggggtcccgggttcagatgagcattcctgcactgcatgctctaaccctatggggttgggaccaggcccacttctttgttctctggcccctttaggttaagtaccgactgaactggaggggctgaggtgttactggtttgctgacatcaacactccacttgggggtgctggcaaaagcacttcattgaacttgtggcagcaggatcagggctcatgtacacctgtgccaggggcaatggcgggagggtgtggatatgtgtcagcagtggcctgtctgcagaagctctctgatggttaggcagagtttgctggtgaagtagctatgacaccagtcaccaggaagtgccctggttggacacctaacgcagagttgcaagtaggcatggtcaggtagggaccctgggagaggtcggcagacaagggggtgctcagatcagactagtcctgacccatgggcaagacacctctactctgtccaggtctgacagtcaacaaaggctagagccacgtagaggagcatggtgcaccttggggaataggcatccctactgggctcactgcctctattcccatgctaaacactctgggcttcacacaggctagagtcctgtcactgccagcactccaagtagctctccctgccagctcaaatttctatgggcatcatggggtctcctgcagttaggattcgagaggtccatgggaggagttagcaaatgctcacctatctaattcagcctttcctctggagacattgagcgtcatgaatgagtcccagtgcttggcagccctgtgcagggttcccgggttcctctcactttggtccagggtctgagtcttgtctccatccattctcaatgcattctttctgacgataccctcagagaatgcaagtcttcctgatggtctgatctcttggtaggagaagctctttctagctgtgtctaattgacgatcttggagctcctcttcctggctttattcttagtgtctagaataatgactagcccatagtaatcggtcaaaaattctactgagtgaatgaagaatgaaatttgtttggccctcccctctttctcccttttcccttcctctcattcccactctagcaactttgacctttgtgtatgttgtctctacttcactatgtggggcagctcaattttctctggccctcacccccagactcagaacccagtctttttgtacttagtggcttctgtcaaatagattcactcagggcctcaacctttcctcacttaattgacctcaccttatcagatgtgatgtgaaggactgagtcaactcttaaggctagtaacccatagcgaaatatctaaaagaaaaacgacatacttaaaagatgtttggaaagtataaaagtaacttctcaagcctaataattatgagcacatatcaaagttttatttcaaattactgcaagagaaaaagctcctcaagaaacaaattcaaataattagccttggtatattgttacaggaatccagatttttaaaaatctggttaaagatcattattgcattcaaatgacggttgcataattaccctgcttttgactgcctgtgtagtgactattaggcttctcacaagattaatggtcatttgagtttgtaacactaatttcccagaaggaatctttatttcattaaaggatattagaaaattgctcaagcgttttattagaagtgatggttaattaccacatggggctatgtatattatatcctccgaaaaatgcctgcttcataccagtttggagaaacttacctttctcagctatgtatgttatatccttcataaaaggcctgtttcataccagtttggagaaacttacctttctcatgtgtaatttaaatctttactttacaaatctttacaactcctttagtgaggatttgtcaggtcttggattttgtcccttcttacaagctaataagcttgtttcattgaggctgtcaataaaaacacagggctccttagtaagagacaaaggatttttattacttatggcacaacaaacagcatgaacactgatatatttccatcagtttctccttcctttaagtcctcaaaagatgatgtaatgggtagtaagggatgctacccatgaagtggtattatgtcacaggtgaggaactctgagcttaggaagttcattgcttttataacaagcactcagccagcttgctctttgtctcagagggagacattacctcatctcccaaggttgcttgctggcataactctgagaagtgatccaggtagaatgctcatgtcattacactgttggcacactcatcaagtcacgtttgagtacaagagactcatggtggactgcctttcaataatatccactccatggtcttacactgggttagttgctagaaatttattttatgagtatgccactttgtcagtcattctgatttgtgtaactgagagatgtcatgactaaatgcattacatttgtctcaagtagcatttaattaaggctactatcagcagaactctaagaagcagaatgagaccaacatgcagtattaaccttaattatgcttgatccagccaaatgtgagtaagttccaaagtacagacagctagcatgtagtattttatctattataacccatacatgaaagttcagactgaaatgttggtctttctttgaattaccacaaagaaaaaaccctaccattcccaatatagagatgttatatggcccctttcccccgggcataacccaaaatgcacaagttaatcaaatttgggatttattattaaacttgatttggataagcattgcatcactttggttaaactacgtgagcagtgtcagtgagtatttgcaatatttgcaacctctgtagccattcatgacataacccaactgtcaagatatcaggggaagcatatacatttgtgtcagtcaatttgagacaaggttgtgctgattcttgtgtttgtatacttatgaagatggggaatctatattggaaagctgccactgataaaatagtctgggagccacattcacaagagttttcctgttttcttgggatgtgggaggagataacaaaccaatagcaggacacagagttgctgcttggctccagaagacaatatgtttgtttttctatacttgttctagcatacaaagagagcattagaccctcacttctccccactggccagggtctaagagtttctcttgctatgtgctcatcatcactaatcatcagagagatatccatcaaaaccacagtgagatatcatctcacaccagtcagaatggctattattaaaaaattataaaacaacagatactgttgagactgcagagaaaagggaacacttatatgctattgatgggaatgtaaattagttcagtgcctgtggatagcagtttggagataccccaaagaacataaaacgaagctatcattttacccagcattcccattgttggatatatatgcaaaggaaaatagattgttgtaccaaaaggatacatggcttcttattattattgccatggtattcacaatagcaaatatgtggaataaaactctgtgcccattgatggtggattggataaagaaaatgtggtacatatataccatggaatactatgttgccacagaaaagaatgaaataatttctttgcagcaacatgaatggatctggaggccattatactaagtgaattaatgcagaaatgttaaaccaaatatcacatgttcttacttataagtgggagccaaacacagaacctacgtaaacatggcaacaactatggattaccaaagggagcaggaactggggggtgcattaaatagtacctatcgagtactatgctcaccacctgggtgtaatatacacatgtaacaaacctgcacatgtacctcttgtacctaaaatataaactaaaatatttaaaaatagactcaaaattagcaccattttcagaagcgtttattttaagataaattgcttttaaatgaaatcttgttttgcaatactctgaggttcacaagacatatctagaaaatgtactattgcggaaggtgaagacggtgtaaaaccagtgggggagaggtcagtggtttttcttattggttgattatcagaacactgtcctttggggatatgaaagagttttatatattctttagacataattagacaaacaatggtccatagggcaggtttgatgctgtacaaagtctgtcattttgctagcactgatatggttcttgggtccaccacagcattagatctgttgatgcatttatattatgctttgttacaaatcttgaaaagaggggtgcttcttacagactttgcttcagatattagattttgttttagtaaattttccaagactgtagtggctgccagcttgtgttactttcacttttcctctggtttttgtatttaccgagaaatggtcatggtttctgtcaagtgcaatgtacccttggagaaaggaatttcaatattagcatctattccctcattctatttcctaggtagttgttggtgggaatgggaaaggttagcctcagccatctttggtgaataccgattacatggctcttgagtggaaaaaagcctgcttcattgttggcctcttcaaggacatgaaacacgttgtggaacagaagagaacagtagttgtctgtccttgtttatctatagactcaattgagtttcttgcatagatagctccctgatagatttggtttgctggttatgtcaggatgaacaaaacctataacttttagagattgattcctaggtatcagctttatacaagaaaggcaataagagggacaggacaaatgaacaggcacattgggttttattgacagtctaggtactaaaggcaggttcatctcaattgcaccaacccaagcaagagctgttttggcacagatgcatcattggtgcaaaatggaatgacaaagtccaagctcctccagttcctggccttgttaaaaaatattgcttaggctatgggctgcaaccatgtttgttttgttcagctagattttaggccatttcatcttggaagacttattttgagttataagaaatttctttaaaagttgtatataacagagtagtataggaatatgtggcctgacattaagaagagctatacagtgtgaaattctccctgaattgcaagaatctcactcagatttctataatagaatctgttatgtctgattttttagttcaggaaagtggctattagaaataagtggtcttactgacccaagagttgccatttgatggaaactcatacacacatatatacccctctgcctttctcacacatacattgactttgacttttaatatagcttaaaagctttattaaaagtttttatttttaattgattcataatatttgtacatatttatgtggtccatgtgatattttgttaggtgcatagaatatacaataatcaaggcagggtgtttagaatatctattaccaagagcacttatcatttctgtattgagaatatttcaagtcctcacttctagctattttgaaagtacaatgtgttgttgttaactttagtcattctactctgctattgaaaattagaacttattccttctgtttctacccactaaccaacctccttttattcccccaaccacatccatttccttcccagtctctgataaccatcattctagtctctgtctccctgagatcaactctttttttttagcttccacctatgagtgaattcatgcaatatttatcttcttgtgcctggcttatttcatttaacataatgacttccagttccatccatgttgctgcaaaggacacgatttcatttatttttatacctgaatagtattccattgtgtaactatacaacattttctttatccattcaccagtagatagacactttgttgatttaatatctttactattgagaatagtgctacaataaacatgaggaggcaggtatgccttcaaaacacttctttcctttggataaatactcagtagttggattgctggattgtatggtagttctattactacatttttgagaaatttccctactgttttccagagtggctgtactaatttacattcctaccaacaatgtttgagagttccattttctatgaatcctcatcacatctattattttctatatttttaataatagcgattctaactgggataggatgatatctcattgtggttttgattcgcatttccttgatgattagtgatgttgagcatgttttaaatacctattggctatttgtcttcttttgagaaatgtcaatttagatcttctgcccatttttaaatgggattgtttgacttttttttttgctgttgagttgtttgagttccttgtatattctgaatttaactaaagtgtcatattttcacttttagcagttcacataacacaggtctgtagttggaatacatctttgatcactttcatgagtcctcaagatggcagtgtcttctcagggaccttgaggcaagctctcatgtgctcctgcggtggggaggggaggggatgcatgtgcacttgcaagtgcacacacacacatgaataagagcaagacagagggagagatgagggaggagcttaatgatggagcagaggtgttaaaaagaacatcctttttctaattggtaggacagatttcttttatgattcctacagcagaaaaatgagaaacgtttgttattatttttttttcgtgtttaaggtttgaatcctcagtgaaccagggcagaaaagaatgatgaaatccttgagagttttactggtgatcctgtggcttcagttaagctgtgagttttgggcatctctgtagaaacataatgtatattgtttgcaattattgtgtattctaggcctgtgggtagaaacatgagtggttttttctctaacaaagggagactggggagagtggggggcccatgaaaagatgatttaaattctgggtacgaagtgtcccctacccaatctgtcttctctgtctgactgctgtcttttttcacaggggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcgcacagtgctccccagacacttgcagtctgtacccaaacctgctgggccccaggaatgcctgatgtagagcttagactgcaaggcaatgaagttctatttgttctctagatgcaaatgaaaactaaaagcagtagtattgaaggtttgattaatttgggacatattttcataattctgaaaattattgagaccccaaaggaaaataaaagacaccatttggtctacttgaaatattttctagtcttctctttccactttagttttgaaattttttttttgctgactttgtggctcatgtctgtaatctcaacacttttggaggcatagggaagaggatcacttaaacccaagaatttgagactagcctgggcaacacagggagaccttgtctcaaaaaaagaaaaaaaatcgccaagagtggtgacatgcacctgtagtcccagcaacttgggagggaagaggtgggaggatttcttgagtcggagaggtggaggctgcaatgagctgtgatcacaggactgcactccagcctggacaatggagtgataccctgtctcaaaaaacaagcaaaaacaaaacacaaaacaacaacaaaacacaaataaaatatttttattgaggtgttattgacacacaaaaaggtgcacatattcactttatacagacaatataatcgtgccataaacatatgtaccatttctaaaaatttgcttcctccctggtttctttttattaagttattattgctatacaaaaaggtacatttatttaatccatgcccagtctacttttatgccacatctttactttatgagattggttttatgattctttttatcaaagacaagaaaatatttccatacaataacagatatgctctcatggttcctaagacattttgctctttccccaaggcatttgatagacattgctttaagaatgaaacagcaaagcagaaatgcaaagagaagaaaaatcataagcagactaatttgaaaatccggtaagtcataaattttttaagttacagaaccctaactccatctccagcctcaactacaacatcactcctgagttatataagggtacacctgatggacagctggaagaactagagtgagagagtgagaactggttgagaaaaagcctaattagttgcacaaactaaagattagagagggtctatgttgccattttggggtaaagttttaatcaaattcaaaactcccagcttgagcctgatgggatagttttttgattcctatgtacttgagtgtggcctggagatgggaaggagcattggctgtagttgtagagtgcctcatctccccagcagggcatgacagcacagaaggacttaaaatttttttgagaagggtctctaagtatcttaaagagatccagacaccaaggtcctttgttatgatgagtaaagacctgtatgaataagataccaaagaccgtatggaattgagaatgcttcaggaaatgtttgtctggagagttggaaacactaaacatcatatgaatatctccatcccctgactacaaggcaccacagatttgccctgcagtgtatgtcaagtatggggaaagcatttgtggcctgacgaaataaggccttttagtagacattactttgaattacaggcaaaatatttgagaatcatatttactgtaaaaatgaagttgtggtctgataggcataacattatttatgtagcccagaaggtgggaaaagcttggaaatgaagaataaatgtttctgtccagttttattgacagtcactgatgaaaatgatgaagccaagtcagaatttgctgcaacttcttactctgcagaagtgaagactctgaacaaatatttcccagtcatagaagaaagatttaaaaagcaaggaggaagagcaaacagttgtgctggaatcaaggtacttaaatttttattccacttttatgatttgccttctggcatcatggcactctggaaagaactcaggctgtggtgctggtttgaacatcgattatattacttatggcctttttcatattaagctctacaattatatatatttcaggactggtttcaggattccgtgagacaaaatattgtcttgggatgagttccttaaaagcagagactgcatttggaattctctgtctgtaatttatttgggaaaccaggttgagatgggggaaaggctggacatgagggggaaaggttgagatgctggacatggtccagcagaggtcttgatccagcctgacctcatggggagctctggagcttgaactgtatcacagggttgattcctcccaccctgaggcaaggaggccagactgctcggacctattgtgggtaagaataaagtcatcattggttgtggtgtttcttggggtagaggtatatgctactggacaatggtgactctcattggctaaggtcaattttctagggaaagaggcaactgtgagccaagagtagccaacattcacagtagctggggatggctacactgtcctaggaaaggggatctagcttggggaccagcagtgctcattattaacatggaacttgcctggtatgtgggtagcatttgagaaataatagactttgagcagaataaatgatatcagagattgaagatcaacttactgaaataaggtgtgaagacaagattagagaaaaaagaatgaaaaggaacgaacaatgtctccaagatatatgggactctgtgaaaagaccaaacctacgtttgattggtgtacctgaaagtgacaggaagaacagaaccaagttggaaaacacacttcaggatattattcaggagaacgtccccaacttagcaagacaggccaatattcaaatttaggaaatacagagaacaccattaagacactcctcaagaagagcaaccccaagacacataatcgtcaggttctccaagattgaaatgaaggaaaaaatgttaagggcagtgaaacagaaaggtcaggtaacctacaaagggaagcccatcagactaacagcggatctctctgcagataccctacaagccagaagatagtgagggccaatattcgacattcataaagaaaagaatttttgacacagaatttcacatccagccaaactacgcttcataagtgagggagaaataaaatcctttacacagaagtaaatgctgagggattttgtctccaccaggcctgccttgcaagagcttctggaggaagcactaaatacggaaaggaaaaactggtaccaaccactgcaaaaacacaccaaaatataaagaccaatgacactatgaagaaactgcatcaactaatgtgcaaaataaccacctagcatcatgatgacaggatcaaattcacacataacaatattaaccttaagtgtaaatgggctaaatgccccaagtaagagtcacagactggcaaattggatagagtcaagacccatcggtgtgctgtattcagcagacccatctcatgtgcaaagacacacataggctcaaaataaagggatgaaggaatatttaccaaacaaatggaaatattttttaaaaagcaggggttgcaatcctagtttctgataaaacagactttaaaccaacaaagatcaaaaaagacaaagaagggcattacataatggtaaagggatcaatgcaacaagaagagcgaagtatcctaaatatatatgcaaccaatacaggagtacccagattcataaagcaagttcttagagacctacaaagagacttagactcccacacaataatagtggcagactttaacaccccactgtcaatattagacagaccaagaagacagaaaattaacaagtatattagggacttgaactcagctctagaccaagtggacctaatagacatttacagaactctccaccccacatcaacattcttctcagcaccacatagcatgtattctaaaatcaaccacataatgggaagtaaaccactcctcagcaagtgcaaaagaacagaaatcataacaaacagtctttcaggccacagtgcaatcaaattagaactcaggattaagaaactcactcaaaaccacacaactacatggaaattgaacaacctgctcctgaatgactactgggtaaataacaaaattaaggcaaaaataaataagttctttgaaactaatgagaacaaggagacaatataccagaatctctgggacacagctaaaacagtggtgagagggaaatttatagcagtaaatgcccacatcaggaagtgggaaagatctaaaatcgacactctaacatcgcaattaaaataactagagaagcaagagcaaacaaattcaaaagctagcagaagacaagaaataactaagatcagagcagaaatgaagtagatagggacccaaaaaacccttcaaaaaatcaatgaatccaggagctgtttttttttgtaaagatcaacaaaataggtggatgactagccagactaataaagaagaaaagagagaagaatcaaatagacataacatgaaatgataaaggggatatcaccactgatcccacagaaatacaaactaccatcagagaatactatgaacacttctacacacaaaacaataggaaatctagaagaaatggataaatgtgtggacacatataccctccgaagactaaaccaggaagaagtagaccaataacacattctgaaattgaggcagtaattaatagcctactaaccaaaaaaagcctatgaccacatggattcacagccaaattctaccagaggtacaaagaagagctggtaccattccttctgaaagtattccaaacaatagaaaaagagggaatactcccaaactcattttatgaggccagcatcattctgatatcaaaacctgacagagacacaacaaaaaaagaaattttcaggccaatatccctgatgaacatccatgcaaacatcttcaataaaatattggcaaactgaatccaacggcccatcaaaaagcttatccactacgatcaagttggctttatccctgggatgcaaggctggttcaacatacacaaatcaataaacgtaatccatcacataaacagaaccaatgacaaaaaccacatgattatctcaatagatgcagaaaagacctttgataaaattcaacatcccttcatgctaaaaactctcaataagctaggtattaatggaacatatctcaaaataataagagctatttatagcaaacccatagccaatatcatactgaatgggtgaaacctggaagcattccctttgaaaaccggcacaagacaaggatggcctctcttaccactcctattcaatatagtattggaagttctggccagagcaatcaggaaagagaaagaaatagagagtattcaaataggaagagaggaagtcaaattgtctctatttgcagatgacatgattgtatatttagaaaaccccatagtctcagtcccaaaactccttgagctgataagcaacttcagcaaagtctcaggatacaaaatcaatgtgcaaaaatcacaagcattcctgtatactaacaatagacaagcagagagccaaagcatgagtgaactcccattcacaattgctacaaagggaataaaatatctaggaatacaacttacaagggatgtgaaggatctcttcaaggagaactacaaaccactgctcaaggaaataagagagggcacacacacacaaaaagaaaaaaactccatgttcatggataggaagaatcaatatcattaaaatggccatagtgcccaaagtaatttatagattcaatgctattccatgaagttaccagtgactttctttactgaattagaaaaaactactttaaatttcatacagaaccaaaaaagagcccgtatagtcaagacaatcctaagcaaaatgaatgaagctggaggcatcatgctacttgacttcaaactatgctacaagtctacagtaaccaaaacagcacggtactggtaccaaaacagatatatagaccaatagaacagaacagagacctcagaaagaacaccacacatctacaaccatctggtttttgacaaagctgacaaaaacaagcaatatgaaaaggggaaagaattacctatttaataaatcgtgttgggaaaactagctagccatatgcagaaaacagaaaccggatcccttccttataccttatacaaaaattaactcaagatggattaaagactaaaatgtaaaaccccaaaccataaaacctctagcagaatacttaggcaataccattcaggacataggcattggcaaagtcttcatgactaaaacactaaaagcaattgcaacaaaagccaaaatagacaaatgggatctaataaaactaaaaagcttctgcacagcaaaagaaactatcatcagaatcaacaggcaacctacagaatgggagaaaatttctgcaatctatccatctgtcaaaggtttaatatccagaatctacaaggaacttaaacaaatttacaagaaaaaaaaccaaacaaccccatcaaaaagtgggagaaagatatggacacttctcaaaagaagacatgtatgtgaccaaaaaacatatgaaaaaaagctcgtcatcactggtcattagagaaaggcaaatcaaaaccacagcgagataccatctcatgccagttagaatggcgattattaaaaagccaggaaacaacagacgccggtgaggatgtagagaaataggaacacttttacactgttggtgggagtgtaaattagttcaaccattgtggaagacagtgtggtgattcctcaaggatctagaaccagaaataccatttgatccagcgaacccattactggatatatactcaaaggattataaatcattctactataaagacacatgcacacgtatgtttattgaagcactatttataatagcaatagcctaccgtagtaaatagcaatagcctaccctagtaaagtttaatattttgaatgaaatatattatgttgtcttacatatgaaaagaaaatctacaggcagaatcaaggaataggtcagaagtgcaagggagaactgatttcccactggcatgagtcaacagagtacacagaaaggaaggagtttgttttgacctttgaaaagaattcttgttagccggttcttatttcacctgagtttttttctttatttgattttttcaattttaggatccaatgatctctatgctaaaataagttgggtgaggaagtcttttcattcaagaatttcatcttcttaggccatagagttgactgctctggttcaatgcatcctgtctcccacccacaggggactgcttcttgcctagctctgttgagtatcactgtcaacctatcctaagtcttctatacctcccattttcttggtcatctcatttcttgtctgctggttgcactcctcccagctttactgagttcacgtaggcttacttttctttctgtatctttaattcttcccataattacttatttatatgttatattttattaccttcattattctgctcaaatttctccataaatgggcttctgttgatgttctttttaaggcgagataccataatttggcataatgtatcagtctattctgagcgttgataattcaaatgggacttttctctaagttttttctcctagccttacaaacatcaaacttgatttgaaaccaagaagtctttttcacaatttctgcttcacaaagaaaattattacctattagtttgcattgactaattagctaatgacacgtgatccaggctgattttaagtatgagtctctagtcattttttttttcctttagcacctaataaaagagaaatctcttccatccactctaatgctcatgtgaatccactagcacagtgccacacgaagcttagctaagcctgaggcaattgatcttctcccctctccttgatgagtgcctctaaaaaataacatagagcatcttaatggtattccaaaatctggaatattgccttctgtgactaatttctcagtgaagtaaattacttttctagttttacataactccaatttcttatctattttttgaggggaaaaacatttttattttctaatttttaaattttatttctttcaactgttattttagaatcaggagtacatgtgcaggtttgtaacagaggcatattgcatgatgctgaagtttggactatgaatgcattgtcgctcaggttgtgagcatagttcctaatagttttcagtccttttctccttccctctcttcccactctagtagtacccagtgtctattgtgactatctttatgttcatgtgtagctagtgtttagcccccacctataagtgagaacatgcagtatttagttttctgcttctgcattaattcctttcagataatggcctctagctgcatacttgttgctgcaaaggacaggatttcatttttctatggttgcatagaagtccatggtgtatatgtgccacattttcttcatccaatccaccaccgattggcacctgagttgattccatttctttgctattgtgaataatgctgtgatgaatgtatgggtgaatgtgtctttttggtagaaaattttatttgcctttgggtatatacccagtaatgggattgctgggttgaatgttagctctgttttaagttctttgagaaatctcaaaactaatctccacagtagctggactaatttatatttccaccaacagtatgtaagtgttcccttttctacacagcctagccaacatctattattctttgactttttaaaaaaagccattctgattggtgtgagatggtatctcattgtggttttgatttacatttctctgatgttaagtgatgatgagcattttttcatgtttgttggctgtatgtatgtcttcttttaagaagtctctgttcatgtcctttgcctacattttaatgcggttgctttttgcttgtcgatttgttgaagttacttttgtttctttcttttttggaaagacagggtctcactctgttgcccagactggagtgcagtagcatgatcctagctcactctatccttaaactccagggctcaagggatcctcctgctttagctgggactacaggcacatgccactatggccagctgatgtttttcttttccttccttccttcctcccttccttccttccttccttcttccctccctccctcccttccttcctctctttctctccttctctttctctttccttccttccttctttccttccttccttccttccttccttccttccttccttccttccttccttccttctttcctttcttccttctttccttctttccttctttctctcactttttttttttgagtcagattcttgctatgctgcccgggctggtcttgaacccctggcttcaagcagtcttccagcttcagccacacaaagtgtggggattacaggtatgagccgtcacacccagcttgttacttatagattctggatataagacttttgtcagatacatagtttgcaaataatttcacccattctgtaggttgtctgtttactatattgatagtttattttcctgtgcacaaactacgtaggtcacacttttcaagttttgttttggttgcaattgctttccaggacttaaccataaattctttgccaatgccgatggcaaaagggtatttttctgtttttttccccctaagatttttatagttttgggtattacaattaagtctttaatccatctggaattaatttttgtgtatagtgatgggttggggtccagcttcattcacatacactggtatgtggctagccagttatccccagcaccatttattgactagagagtttttcccaatttcttatttttgttgactttgtcaaagatcagatggttgtaggtgtgttactttatttcagaatttgctattctgttccattggtttatgtgcccatttttataccagtactatgctgttttggttactgtagacttgtagtgtagcttgaagttgggtagtgtgatgcctccggctttgtgcttgttgcttagattgctttcactatttaggctcttttggttccatatgaattttagaatagttttttcctaattctgtgaaaaatggcattagtagtttgataggaatagcgttgaatctgtaaattgctttgagtagtatggacattttaaagatatggattctcctaatccagggtatgcaatgtttttccttttttgtgtgccatctctgatttctctcagcagtgttttgtagttctctttgtagagatctttcacatccttggttagctgtattcctaggtatctattctttttgtgtctattgcaaatgtaattttgttctttagtctttaggaccctgctcaaggtcctgcagcattgccactgctgagccatgctcctgctgctcggcccagcactccagtgtcccagctgtcagcttgaacagacagctcgaacattattggtgtatagcaatgctactgatttttgcaaatttgttttgcatcctgaaacttcactgaaatcttttatcaagtctaggagcctttcggcagaaccttgagggtttttctagatatcaaatcatactgtcagcaaagacggataatttgactgcttctttccctgtttgggtacactttatttttttctctttcttgagtgctctggctaggacttccaatactatactgaataggagtactgagagtatacattattttcttgttccagttctcaaggggaatggttccagctttttcccattgagtatgatgttggctgtttgtcataggtggctcttattattttgtggtatattccttccatgcttagtttgttgagggtttttatcataaagtgatgttggactttattgaaagctgactgcatctattgacatgatcatatggttttgcttttaattctgtttctgtggtgaatcacatttattgattcgtctatgttgaacaaaccttgcaccccaggaatgaagcctacttgaccttgaattaactttttgatgtactgctggattcagtttgctagtatttttgttgaggatttttacgtttaagtttgtcagggatattgactgatattttcttttttcattgtgtctctgctggattttactatcagaatgatgcagactacattgagtgagttaggaaggaacccttctcctcaatgttttgggaatagcttcagtaggattggtaccagttcttctttgtacaactggctgaattctgttgtgaatccatccagtccaggggttatttttggttggcaggttttaaaaaattattattactaactcatttccagaactcattattagtctgttcaggttttcaatttcttcttggttgaatatatagaggttattttcttccaggaatttattcgttttctccaggttttctaatttttatgaatagtggtgttcctagtattctcttagggtcttttgtatttctatgggatcaattgtaatgtctcctttgtcatttctgattgtgcttatttggaacttctctcttattttcttcattaacctacttagtggtgtatcaatcttgtttattcttcctgaaagacaacttttggttttattgatcctctgtatggattttcaagtctcaattttgttcagttcttttctgattttgtttatttattttcttctgctagcttttggctttgtttgttcttctttttctagtccttctaattgtgatgctagaatgctcacttgagatctttctaatttcttgatataagtatttagcagtataaactttcctattaacacctttagctgcaaaccaaagactctggaattttgtctttctgttttcattaatttttgctctactttgttgtttacccaaaagtcattgaggagcaagttgtttaatttccgtgtaactgtgtggttttgagagatctccttggtaatgatttccatttttattacactgtggtccaagattatgcttggtatgattttggtatttttgaatttattgcaatttgctttatggcttcaatttctcaataattttgagattaatatcatgtactatacagaaggtaacatcatcacagattcaggaggaaagaaacgctttctgttgaagttttgatatcatgtctgaaatgagaaggaaacagcttgctcccttggatccgtggttcctcctgttgcctctagagggcgatgttgcatcaagtaggcatctgttttcatcgcagaccatcctcatccattgagcctcctccctgtagctggctgatgtagctcgttgatgtctgtgtggatagggagctgtgacgagagcaagaggtcagaacacatccaggctccttaagggaaagcctctttctgtttctgaaacttttcaaagccagggacttgtccaatccaacctcctcacagttcctagctcctgaggctcagcgcccttggcttctgtccgcccagcttaaggtcctgcagcattgccactgctcagccatgctcctgctgctcgtcccagcgttccaggtgatttttaccctgggtgagtaacattccattctttttccttccacagaagtgactgtgttgtaactgaatctaaattgagacacattttttactcaaacagcattgatgttgcaggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttgaaagcatcaacggttttgaggctgaatttaacaagagtcaaacttccttccacttgaggaaaccctcagtccatataagcgacacggctgagtacttctgtgctgtgagtgacacagtgcctgagactgcaggagagctgaacacaaacctcctgagatgctgagactttctgtgactcaagaactcaacctgtggagctttcaagagggtcccttttttctgtgcccgttttgaaggcacatagggcagggtgggctgagcccttggtagggtttgtctccggaataattgctccaatgtcaatgtcatgccacattcagatatgctttgtcccacatggaggtttcctgatgaatttcttcagtggggacctcctccacactctgaagaaagcacatcataaggtgtcagaactccgaaataaaaggcaacaacatttttatacaaaattatttctagcaaccattatgattagtattgcctcaggtgttaacttgtgaataaccgatgtaattgattagaatgttagctaaaagctgtgcaggatggattctcaattagggtaacccatacagcacagattctcaatcagtgtgctgtagattctcaacctagatttgaagcttaacttctagcacatacataatatcccactgtgtggtattgacatatttaaagtaaattagacataatatcaagatttttaatcttgtgagcattatgcaaaacaggaaattaaacataaatcttaatacaatattgaaaaactaagctgtcaagttgtgatcttttttaaaacagctattccagtgatttccaagttacaaacttgagggataaaaatgtaaccaatataaagatatcaaataccctagattcaactactttaaaaactactttaaaactccgaggcattttattttaagagattacacagatttattatataaaattacacaacaaaaaattccagttgcattatcagagagtatatgaattctaatgggcatatccaagaccagggtaccctattacttactctgaaataattatatcgaaaaaccaacatgttaagatattttatgtacatgattattactccaaatttttatttgtagtttgatcacatggtagaattaaaaaatgcctctcaaagtattataaaatgttcacacatacagaagttgtcttccttaattcaacattttgtaatttttgatgacaaaaattatgaaatgaatcatctcacttcttaaaaatatttacaattgcctaaatctcctcttttaaaatgagatgaagttgtattcttcccttattataaaacatgtgtttaaagtagtttaaaaatattcctatgaattgagctaaaagagggtagagggtttataataaaaaatatttagacttggcttcttctcttgcaccaaagactcaggttcttgcttatggtttctttggctgctgacattctttagttacttcttagcgtgccacctcttccagttttactttcgtcctcatttcattttcgtttgtagtttttcttacagatttgtcttttcattgtgccttttatggcctgttattttgattatgttcagattttacaggccaagaacacttaacatgatgtctattttaacaaatttttgaagtgtacaactcagttaactattggcccaatgttgaatagcagatctctagtaattcttcatcttatctgatagaaactttgtaccccttcatcaacacctccccacttcttcttcccccagccccaagaatggtaaccaccattctactctctacttctattagtttgacagttttagatatctcatgcaggccttctatgactggcttatttcacttagcataatgtccttagggttcatccatgtttttgcatgtggcagaatctccttttttaaaggttgaagaatattccattttatgcatatatcacattttcttcattcatccatcagtagatatttaggttgttcccatatcttggctaatgtgaataatgcggcagtgaccatgggagagaaaatgtttcttcaatatcctgaatttaatttttttgataaataaccagtagtgggattgctgaatcatatggtacatttttaattccagggggaaactccttactgtttttcataattgctgcaccattttgcagcaagggttccaacttctccacattcttatcaacattgttgttgttgttttataatagccaacctaaaaggtgagaggtaataactcattgcgatatctaatttatctggtgattaatgatgttgagcagattttcatataacttcagccatttgtatgtcttctctggagaaatatctactcaaatcctttgccaatgttttaatcaagttattaaaacattgatagttataggagttccctatatattttgaagattagccccttatcagacatatagtttgcaaatatttctttcactctacatgttggctttttttcctattgattattttctttgatgggcagaatcttttaaattttataaagtcctgcttatctacgtttggttttgttgccagtgcctgtggtgtcacatacaagaattggctgttgcttagaccacatgtcatggagagtttcccatatatttttccaatagttttacagttttgggttttacgtttttaattaatattgagttgatttatgtgtattatgttagctagaagtccaatttcattcttttgcaagtggatattcagtttccacagcacaatttgttgaagaactactctttccccattatgtatccttgatgcccttgtcaaacatcagctgagtgcgtatgtgtgggtctatttttcagctctctattctgttccattggttcgtatgtttgtctttatgatagaactatgatgttttaattactgtagctttgtaatatattctgaaaccaagaagtggggtgcttttagctttgtttttctttctcaggattgtttgagctattctgggccttttgtgtttccagagaaattttagaattaaaattttagttttttctatttccataaaaatttcattgggattttgatagggatagcattgtagattgctttgggttgtataaacaccttaacaatattaaatcttccaattcatgaacatagactatctttcatttatttgtgccttctttaatttttcttatgaatgttttgttgttttctgtgtacaagcctttagactaattagttaagtttacttctaaacattttaatcttttgtagctataataaatggattgttttctggattttttttcagatagtttattgttaatgtgtagaaatggcactgatgggcctggtgtggtggcttatgcctgtaatcccagcactttgggaggccaaggcaggcgaatcacgagatcaggagttcgagaccagcctggccaacatggtgaaaccctgtctctactaaaatgtaaaaaattagctgggcatggtggcaggaacctataatcccagctactcggggggctgaggcaggagaatcacttaaactcgggaagcggaggttgcagtgagccgagattgcgccactgctttccagcccaggcgacagtgtgagactctgtctcaaaaaaaaaaaaaaaagaaacggcactaatttttgtgtgttgatttttataccctacaactttactggattcatttattatttctaataggcttttttggtggcgtcttcagggtttttaatgaatttatgtcatctacgaacagaaataattttacttcttttctgatttgagtacttttaatttctttttcctgtctatttactctggctaggatttctagtattatcctgaatggaagtggtgagggtggttacccttatcttgttctgatcttagaggaaaagcttttttgtgtttcacacaccactgagtgtgatgttagctgtgggctttttatatatggcctttattatgttgggggtaatttcccaatttgttgaatatttttatcataaaatgtgaagcaggttcactgtgtactggttaccaagttgtctgagtccagtgagacagaatacacatgcatacaacaaggtacatgaaacaggtttattgattacagataagcaagggacaacagaagcttaggtttcattgcaaacaggtcccccagggctcaggaaagctgtctagggtggatagggtgtcatctgcatgtggcccagttgtaccacacctgagggaccccagaaattagcatgccctaggttttagacccctgggtaatatgataccctgggccaaaaagtactgaaggacactgtttctagggggtatctgaaatacagccagcctgttccagccatttcattcctgtctgaagatgttacattcccagtacattctatagttattcttatttatttatttatttatttttgagacagagtctcgctctgtcgtccaggctggagtgcagtggcgcgatctcggctcactgcaagctccgcctcccgggttcacaccattctcctgcctcagcctccccagtagctgggactacaggcgcccgccaccacacccggctaattttttttgtattttctagtggagacgggacttcaccgtgttagccaggatggtctggatctcctgacctcgtgatccacccgcctcggcctcccaaagtgctggaattacaggcatgagccaccgcgcccagcccattctacagttattcttgagaaccacaaacaagaaagtggagagaactgggttggtccaagaccacccagagaaccatcctgcatgaaaggatgttgaatgttgtcagattctttttctgcatctattgagatgatcatgtaatttttatccctcattgtgttatgtagtgtgtcacattcattcatttttatatgttaaaacatccttgcatcccagggataacttccacttggttattgtatgtgatcctattagtgagctattgaatttggtttgctagtatttcactgaggatttttgcatctatgttcatcgggaatattggtctgtataccttcttgtagtgtctttgtctggctttgatatcagggtaataatggcttcataaaataagtttagaggtattcccctttgaattttttggaagaatttaagaaggattagagttaattcttctttaaatggttgatagaactcactaatgaagctgtcaggtcttttgtcttctttgttaggaggttttggattactgaatcaatttccttaccagttataaatctgtttagatttttttatttcttcatgattcagtcttggtaggttatatgtttgtataaatttatgcatttcttctaggttttccaatttgttggtgtataattgtttgtaatagtctcttaagattcttcttatttctgtggcatccattgtaatgtcttctcttacatttttggtttatttgaatcttctctcttctttttcagtctaattaaaagattgtcaatttagcttatgttttcaaaacttagttttgcttatttttatgttattttctactctatgttttatttatttctgctctaatatttattatttccttctttctactaaatttggacttcacttgttctttttttctagttctttgagatgtaaagttatgttttttgtttgagatcttccttttgaattcaggtatttatttctataaacttccctattagtacagcttttgctcactctataaattttgatatgttgtgtttttgtgtttgtatctcaaaacattttctaatgtgccttttgatttctttgaccaatttgttgctcaagaatatgatgtttaatttccatatattttggaattttctagttttgcatctgctatttatttctagtgttattccattctcattagaaaaaatacgtggtatgatttcactttcttaaatttgttgagacttgttttgcggctgggcatggtggctcccacctgtaatctcagcactttaggaggctgaggtgggaatgcttgaggccaagagtttgagaccagtctgggtaacagtgagactccttctacacaaaaaatagaaatattgacctagtggggtagtgtgcagatacctgtagtctcagctactcaggaggctgagatgggatgatcacttgagtccaggagtttgaggctgcagtgagtcatgatgctgtcattgcactccagcttggacaacacagtgacatcctgcctcaaaaaatgaaacaacgaaaactgccctctttgttttcagtgaccctatgcatcgggaatacactgggtcctatcagtgctccttgacaggtgtgatggaagccagtctctcaggcagcctgtggcaaagctagaatgttggatgtaatgtccaagtctttccctccccagggagaggctgaaactggggctttcctcttatttatgggacacagtacagggggtaggaaaatgtcagaaaccctcctgtcatctttgatgtggttggttgcttgctcattcaaggtactggagactctgaactagttactggatttttcacaagtgaattgatttatttattgctattgaattggtgtgtccatcggggaaaagagggtccagggatttcttttttgccatctttctgatgttacacctttcacggacagaattcttcctgttctcatgggcttctttatttgcccttcaccagaactgacctcctcttgggcatctagttgaatgtggttttcactgtgggcatggtggtcctgcctgagtgccagcaggccaccctgcaatgagagctccatcatacactttaaactttccttgatatttcttttagctgtgcctcttaagcagtagaaggctggatatgaaaaccattcagataatttctatatcttaatagaaaaatttagccttttaaacttatatatgcatgcatttatggctacaactaatatttttgagttatcttacatggcatagtgacatttgacattgtagaacacttccttcctggaatgctttctttattggtttttagaaatcccactcttttttccctctgcttcagtattgtcagttgttccttctcagtcttttttgctgttttttccccacatttaactaatctttaaacattggcaagccttagaaatttatccttgaaaatctttttcctctataaatactttattcacagctggttttattcagtctcttggctttaaatcccatttaaatatccaaacttataactgaatcccagataactcatctggattctggatttgagtatcaaataatctatttgacatcttctttttgacatcctccacttaatatatctgaaaatagtctactgaatttgacctctatactcactaagccttccttacatcccactcgcttcttgtgaacatttcttcattttggtaaaagacaactccatttaccaaatcttctaatccccttagccaaaaactttgaaatcatcattgtcttatcacttttctcacatccccacttgatccactaggaattcctatcagccatttcttcaaaatatccccataatcaaccagttctcatgacctttactgctaccactctgatccaagccacagtaatctcttgcctagttgattgaaagaaacctaactgaacttctttcttttgccattgttcctcttctgtctgttctccatgcagcaggagaagcaatctctttaaaacataattcagataatttcatttctgtgctcacaactatgaaatgtcttaccatctcactcaaaggaaaaccaaatgctttactataatatacaagtccatttagctccctgccatatctttgacatttgacatcagctaccaccttcctacttactcccactctccagcctcaatgcacttattgttgctctaacataccaattattttcctgcctcaaggtctttgcagctgctcatttctctgccttgtgtactagtactccaggtaaccacatggcttatttctacactttattccaccaaatagccatgcacaaaatatttactgcagattatttttgtaatagtgaaaattaaaacacaagatgtttctcagagaatggctacagaaactgtaataaatctttactatggaatattaggaagcaaacatgttaacatcaataggttatcaggacatataattgggtaccaaacacattgcaaactgctgtgtgcttgaaagttatagtcagacaaaaatttaaactgtataaatattgagtatgtattcatccacgtgttctgcaataattttaaattaataataaaaaaataggctccaatttctttctacatctttgtagaaataggctccaactccaatttctttctacatctttgtccatttgctcttctttcattttcatttagtaagggcctctattcaactcacaagcttatttagcttcttgattgcattctgttttatcttttctaggaacagacaacaatgatcatattcttaaatctttgtctaaccatcctttgttttaagaaatggctccttatttctgggttcattttgtactttttgaggtgttacttgatatatatgaaaacacacacatgtgcatgtttgtctttcccactaaactgcaatgtcttgtgagtagagaaaatgtcttactaattttttaatttcgtaagacctagcacaagatctagcttacagtagacctcaataaattactaaagacttactttgaaataaattggagaaatcacattaaaccttgaggaagcaatttgataaaatattttaatatggtaatctcttgtacatggaatttggaggaagaaaccagtttcctttttttaaaaaaaaaaaatcaccataagcctgacagtttttttgctcttgacaatctgggtggttcctcaggaaagaattgggatgaaggctctgggactccacagatgagttagtgggcctgatggtttcagaccactaggaggctctctaggctttactctaaatgaggaaattttccctcaagttctgagatagctgactcagcgaaaaactgagagttagcatcagttagcaaagcatctgaactagtcatatatgaaacggacagggggagtctccatttattcatctgcaaagatgttctgtggctgtgatgggtgtcacagagacggtctcccaagaagactgatcttagaaatcaacaagggaaatgataaagctggaagccttacagctttaatttttatgactaaaacttctaaaatatgagtctccattctgactttgaaattatttcaataatttccaccttcttttatacctcctttgaaactagaaaaacaagaaaaaggaaatgagaagaaatgagaaaaaaataatgaaaatattcagagagaggataaaagagagtaaaagaaataagaggttgggggaaaaaaagatgacacatttaactgaatttcaaaatgtggtctatgcctcatatagtttctgtgttgcaaggttaaaaagttctagagatctgatgcacgacaatgtgaagatacttaccactactgaattgtacatgttaaaatagtcaagatggtaaatttaatgttatgtgtttttttaccacaataaaaaatgtgacctctacctcttgttcacagagcagaattgaccaggtggggctgcaaagtgaatggagaagtgttggatagaagaagagagatggaaataagctggggtggccatcatatacacgtgctatttctctatcaaccaaagtctcactggagacattttatatgttcatgatgactatatgtcctatgttaacagaattctcttaatttaattgtattgtatttactcctttaagggtgattaaataaacgatgcattcgatgagatattctttctttgtgagagctttcttataaataaaatcacaatcacttttcaaatcacatgtcctgattttttggctaaggaaattgggccactgaccctgataattttttcaggctgtacttgatccagatgaggctcccatttgtctctgagatatcttttccctttcttcactcccctcctgacttgtccgattactgggtactttaagtggaggcaatcctgagagcataaaaacctagacatttctgtgtctctagtcagcagtgcggcactcagcagggtactgacgtcagcaattacgcccgtacactgcaggaaaactagaggaaaatctctttgctccctgatctcattgtattccacctcatttaagtaacagcatatctcttacttttttctcagctatttggaggccagaggagagactttctcaagagaattagttttcttttttagaaaaaaatatatctgccggagacgctatctccatgacccatagttttctgctcttaatcccggagcttctgtctacttgaccccagatttatatctgaccccaaaatgggacacctcacttgagctctctcaacacagcttgactgggagctggagaaaatctttggttaaggaccagggattggggactctttcaatctaccatttttctagaatttccgtctttctgagccaaatgattgttcctttttttatggccttcttttcttttcttttttctttttttttttttaaagtgtatagaactaaaatcccaaagggccatttcctgtgtggggaaggtcagaatcaatgatggtggacggaaaataaaataacttgatctggcaatgtttaaacatttcactaaaatatctgtgtagaaatttaaatttctatgaagtgtaatcgatcaatattttttcttatgttttttgactgttatgcttagaaaatccatcaccattctaaatttattttaaaaattttttattttacttaaaatattaaatgttacgtcctttgaactttatttgataacaggtattaaggtaggcatcctaacttatctgttaacttccaaatgattgttaggattgcacattttcccccattttaactaagtttccaaatgtatttgtatatttgaactttgtattctacttcattaagccctatatgtggattttaaaaataacattctattgcaattagtatagcatcacacttttactgaggaggaaattctcattctctgaatttgaaggcttcctgaagcctgagttagctgcagtattgtatttggcctctagagagagatgttacacaaattgaatttgatagccaaaaacaacctgatctttttgaagaatagcttttggctatacatgccgggtaaactcatccacctctctgtcagagtgtctatgtggctgaatcgtttccagaaaagacctccagaaaatagcttcctgtttctccacaggtcagacatgaagcccaccctcatctcagtgcttgtgataatatttatactcagtaagtaaagcctctttttgttctatttttctatggtattctgatttagaataactttaatgaatattatccccagtctgtaagacttttcctgatccagaattggtgttataggaggaacaagagcccagagagtgactcagcccgagaagctcctctctgtctttaaaggggccccagtggagctgaagtgcaactattcctattctgggagtcctgaactcttctggtatgtccagtactccagacaacgcctccagttactcttgagacacatctctagagagagcatcaaaggcttcactgctgaccttaacaaaggcgagacatctttccacctgaagaaaccatttgctcaagaggaagactcagccatgtattactgtgctctaagtggcacagtagctggttttgcaaggaagcagaacacaaaccctttaaatacaggaaatatttctttgcaaactctctgtatggccacagcagggcattctttctccagaaattaatattgagtttatctcgtagatattatatcatcagtcatcagttagctatagattaacctcataattttgtccaaaaaattctcattatttaccctgcttaaattaaatttaaaaatagtaaatgtatttattttgtctagtagtactggaaacatactttcgaaataaaaactatattgcactgcataaaaagtattcttttctttgttcagaggtactgtccaggcttccatggtgcagtcctacctcttcaactcctctgctgccccacgtgatccccacatgtggttgtcaccacatacctgagcatagttcctcaaagtgctctgctgtttcatggcttatgattgttcatctttctatatctattacccttctttccatgagtttcatagactcctcctatctcaattggtgtccagccaggaaaaaagaagcccagtgaagtttaatataaagatttattaaataataataagtaattaactactaatgggtaaaaaaacctctaaggaatataggaatgcacatgtaagcagaagttcctgtctctaggactaaggtagaatcccaggaaaggaacagattggcataagcatgacccctcctgccaaggctatgattcagatctcattgagagtgtgtagctggagcttgctgcatagtggagtagtttgctgaggtgccagagaaaaatactgacaagcagaaaaatacctaccaggattacaacacaattcatgggaagcccgcaaacgagtgctgctgaacttgcttgtggtggctgtgaaacttgccaagaaaccacctgtcgggcttgctggaggggagtgccactggtgtcctacaggccaacgaagcatagtggacaagaagtgtggaaaacataccagaaccaggaagagaagcgtcatccttctgcggggtccttccagccccctctactgacaaagcttaatatcaaatatttagagggtccagatccagttcacaaatagggtaattagggtggatttggagctgagaggtaatacattgataactgtcacaccctatcccttgggctactgatctttcatatgcattcctttttttctttcttctttctttttttgagacggagtctcattctgtcacccaggctggagtgcagtggcgcaatctccgctcactgcaatctctacctcccaggttcaagtgatttttctgcctcagcctctcgagtagctaggactacaggtgcctgccaccatgcctggctaatttttatatttttagtggagacggagtttcaccattttggccaggctggccttgaactcctgacctcaggtgatccacccgcttcagcctcccgaagtgctggtattacaggcatgagccactgcacctggtccatatgcattcctatatgcacatttcaacttccaaacaatagtgaaatgacactatgttgctacctaataagctgaagctgtccttgaacaagtggagttttcattctttctcccaaatgagatgatccatagtcccaacaaccactgtatgaatccctgactgtatcagccacatctcaagttcagaggaagttctactgaatatgctgttatatacagactaaattataaagctaatctccaataatttacatataaaataattatgataagaaagagagaataaaatggcagcatatacaaagaaacacttacatataatgagcaaagataaaatacagaaagctaccacattccttgattccagacttggtcctgggcttcaattgacatagacagcttccttctcttgttacgtattttatattcttctgccctcatccacgtcatcggtggattggagttatttacctggtggaatgacaaaaatcttcattctcgaagagtctgagttctcaatagtcatggcttttaatttgttgctgcaggtttcccttaacttttactattgggcacgaaagtgccattaggctcctcaaaaaaatcccccgggttttagatgtagctctctctacatgtgttgtatggcttctggagctactcgcccccttcctaacaactttgcaacatgttctggtaaccatcacggtatattaaaactttatcgtatctcctcttcctgttgagctgaatgttccagagaagggccgttatgttctctctggctttaatctaaccttctaacacagtatggagcacacaatatgtacacagtgaaggaatgttaaataaattcatttaaacaaatagaaaaatcagcaatcctctcctgtgagcatgtgagtcaacctccactaatgtgatttcactggtttcttcagggaaccgtgtcaaaccaattaatacaggcaaacaatatgttcatctgggcaaacagatgcctaatcaggttaagagttttcttaattggaaaaatagcttgcttatgaagacaatagttttatcaataaaactcacctcaagaccttcggcacatcattgtaccaatcctaaactcgtatatcatgaactagagaaaatagctgagaactagagctagatagtgagttcttggacatgcacacaaaaagtgcagtctataaaagaaaaaaacgataaattagccttaaataaaattaaaacctttggcattgtagaaagaccttgttaatagaataaaaggcaacctatagacagagagaaaatgtttataaatcacacatcagacagaagtcttatatctacgatgaataaagagcacgcaaatctcaatgtaaaaaagaaacaaataaataatccaattagaaatagaatagatatttcaccaaagtagaaatatgggtgaaaaataagcaaataaaaagatattcaatatcattcttcactagcaaaatgaaaataaaaatcacaatgagatatcactataaacatattagaacagctaaaatacaaaacagtaataatactaaatgttggtgagtatgtagagaaatggacacttttatacattgctggtgggattgtaaaatagtacagccattctggaaaataatctggcagtttttttataaaactaagcatgcacttatcatatgatcacaccattgtgcattggacatctatcccagtaacattcacataaagtcttatacaacattcatagtagctttattcataattgccaaaaactggaatcaacctagatatttttcaacgggtaaatggttaaataaactatcatagttcataccatggaataatatgaaaaaaaaagaacaaactgttgatacatggaacaacctgtatgggtcaattcccaaaggttacatacagtttgattccatatatataacattctcaaaataacagaactataagagatggttgctaggggacagagattgggcatgggagggtgtttgtgcatatagagggttaggatgagagaattctatgttgatggaacagtctgaatcttgattatgttggtggttatatgagataaaatcaagaaccacacacaagtatgcatgcacacacgtggagaaaagcaagaaaatagtgacaattgaatactacctgtagtctagttagtggtatttgaacaatgtcaatttcctggtatttatattgaatttcagttatatacgatgtcaccactggaagaggctatgtgaagagtacatagggttctataaactattttggcaacttgccatggatttataataatttcaaaacaaatacagtactatagtttcaaaaattgcattctttactctcaccaccaattttatcagtaaaaccgctaagagttgggaaggtgtgaagccgatggtagtggatgcaaattttccaaaattctaattttcacttggaagctcaaatattatcatgggtgacaaccactattagttgttttcctcaaaatggcaggctcacattttatcattttcaagaacataccttccaactacccaaatctgctgttctgtcactcatgccttcaagtaaaaaaaaaaaaaaaaaaaaaaagttctatgagaaacagctagtttagctcacaactcaaacaatactccagtgtctttctctcttgaggcaccaccgtgttagtacaccacagatgaactttatgcatacgtcctatgtcatcacacagaatatttaaacggtgtactctcaagggtcaagatttaatttaaaaaattttgcttctacatctaggacattgttgagtaaaatctttttctcttgccagtgtggtggtaatgattatgtacaatgactactagaatattttgggttcatttattttacctgtgttaaaacatcagcaattgcatttgcttcatcagtgtaaatgtcaacacagtgaaagactcaagtaatatcagcactattataaaaatagttttattctacctcacagttttaactctatctcacagttttcccaagaggtcagcaatatttctggttactttttgcagatacagctaaatacatacaaatattaaaagtactatattcttgacctcctcattgtgagacattagacacatcatttaatttctttgaaccagggtacatcttttaactactattctaaatttgctcacagactgtttcaaaattatctggaagagagcagacagattaaaatttcagtttgttaaataacactggttctttgctcaaaaagctttcatatgtctttatttcgcactgaaaaacataaagatttattttggcagtcatctgacccagacccttcctctagacttatgtcttggaaccctccaatctacatattgctctagccagcaatctcttcttctcatttctttttttcctttctctgttctcctgtcttctcatctttcccatctctctctctgttttacacacaaaataccttaaaatcaatttttgggaacatttataaaatactctagaagattcttgctattctttttgactgctctgcatcaggacccattttcttataacaataataatttttcagtcactaatgaatgtcaggcactgtgctaaatgacattttatgatctcatcgttaaccttcaacagctctgaaaaggtagtattattatttactcatgatccatgttctacagccaagataatgtaggcacagaagacagaaacagctactgaactgatagatgtaaacctgacttcgatggcctgactataaaacttcctctcttcctggacccgcctgcctcctgccatagaaactaaaacttctaggtattcactgctatgggctgaactgtgtttccacaaaatgtggacgtagaagcgctaacccccagtacctcagaacatgactctatttggagacagaacttttaaaggtaaagttaaaaggtggtcttgagggtaaccactaatttaataagactggcatccttaagaggagattgggacagatagcacaggcaaagggatgaccatgtgaagacacaacaagaaggcaaccatttatgagtcatggagaaaggcctcaaaagaaactaaacctgccagcactttgaccttgaaattgtagtccctaaaatcatgagaaaataaatgtttgttgtttaagccatgcagtctgtgatactttgttatgggagccctggtaaactaatacagcctactggttaggcttgatgtgggcacatggcttgggctccaacaattagatgaattgttccctaactttcactcaggagttacttttgcaaaaaaacaaaaacaaaaaacaaacaaaaaatgagtaagagtttcctttttgagagtggtggtaattgcaacaaggtggacatgagagtttacaggctacaaggcagtggaattgtagctgcatacattgtcctgcgtgaacagtcttgcataaactacgggcagtatctggagctcaggaaaggagccagtgggatactcagaggagtgcttctccagagtgattttctgtactgctgctgacttcatagcttttgagttcagttctctgaccctactggagattctgaggtaaatccagtattcattaatttattccttttctacttaatttaggcagagtccatttctgttgcccatcagtaaaaaccttgacttgtatataatctcattccagggaaaattttttaaaaggaagctcgtaggtacatgatcagaggtcatagtaactacagggaatttaacagtgcttctcagaggtagtctgaaaatattgagcaccaactgtctttcgtagttgagttcttacctgaattgaaatgtatctgttcctattctaagttagaattagatttcaataaaggcagagactggaatagctttgtaatttcttctgagtcagctctgaacacacgtcctgatggcagcaggatgatgttacgatcacaagagggcagtgcctccctctcctcagactaacttggctttaaatcagcctatctgcattgaaaggaaaggactgagcttgcctgtgactggctagggaggaacctgagactaggggacagaaagactagggattcacccagtaaagagagctcatctgtgactgaggagccttgctccatttcaggtcttctgtgatttcaataaggaagaagaatggaaactctcctgggagtgtctttggtgattctatggcttcaactggctagtgagttggggattttggtgatgggaatggcaagaccaaattttagagcccacagggctgaggggtgaagtgttcttattaatttggaaatgtaatttgaaaatgtaatgactgactcctggtcccggacctgtgtttctgcctaggggtgaacagtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggacgcacagtgttccccaggaacctgcagcctctacgcaaaccctgccaaagcagcttcttagaagccctaatagtgggtagaattagtggttatgtctttcagtcaagaagagtctacaaacagctggcaaagtaaaaggggaactctttcaaattcgtgattttttaaaaagcatcttggactaggggaaaaggcatgaaatttggaacaggaaatggaaatgccaggctcagttctgctaatcctggctacatagggacattgtcagtgtagcagccttcaatttcctcacttgaaataaaggatatggatcaatgagcccaaaatattacttaatccctaattttattagggaaaaaaatcactgggcacttgtggaagaggaggaaggctgcacagttttagaaggtctcatttgtcctatgtgcagccctcccaagacatcagtgggtctttaaggtgcatgaggtggctcttaggttcctctaattcttgtataagaagcagtagattcattaagcattagaattggaagaggtcctaggactctcaaccaagcttttcattttagagctgaggagtaaaaccattgcataataagacagacaattttctgaatctttggagtgatagtgacaaatatctggatctgatttcaccatttattagttgtatgattcccaagcttcaatgtctctattaggcaaaatgggaatttataagaaagtaacaacttttccccatccaaaggagagataggtgtttgacactaccaggtcctaaaacgctgtgttttgaaagcaggcatttttagtaccaaatacataacagtttttcagctatttattcttgctcctactgagaaataaatactgactatagttttcttgacacagtttagatactactgaaaatgtgtttgtggagaaaattagagcatttgtatttaggttcatgctttggtgagaaaagtgggggagggcagggaaaggttgtgtcagaccttgacccattaatattagctgtaccagaatcactagagtatctttgaagatctggactattaagctcaattctggcttactcaatcagcctctgataaagtgatgaatttcaattgtaatgaatatcttctatatatgtaagagattggctcaggttcacatttaaaaaacccaaacaataatgtttgtaacaagattgacgagtttttttccacataaaggagctctgtaatattcagggctggtgctgtagcttcatcatgttacaaaggaactagggtctttctagcttactgtttttcactcttaatgtgtcactcttttttttacactttcaagagactgatagagatccttccactttatacaccttccagactgaaagaaggagaaagtcaagggcacatgtacatgctggctgagtcagtcttttccagaagctccgcccaatggcttctgcttacactcatttgctagagtggtattcgatgtttccacctcctcctatctgcaagggaggctagaatatcaggattattatctaagtatatttctattcacagcaaaatttgggttctattagtaaaaaaaataggtgatgatggacattttacagacaattagaagtttctgccagaccctcagtttaggacatattaggactcataatatttttggttcatagttatttttgaattaccatatccaatgtattttcaagttctattgagtgtaccacctactaagttttccagaagacattacaacctctataacctaattcacctccacacccaaatttaaaattctccctaatcgcttactcctctgcccccagcaagcttgacagaccccatcacttctcagtatagtgctttgtacacagtgagggtgaccttttcagagtgcaaatttgaccatgtcaaccacctgggtcctcactggttcttagagtagaaaaaaaattgcttcatgtgatttacaaaaccctccatgatttagactcttaatacctctccagtatctttccacaataagctcctaatttatctttttcttcaatactggtcctatctacgtttcttgaatgcactttgtttatcttatataaccccctcaaagcaattttaggatacattcttactctttttaaaaaattattttctcttcccttgagagtagagcccagtaaatgcctacttgttctcatacgtctgttcaagagtcagtaatagaagaaagctcaatacgctttcttagaattgtggaccactgcctttttaaatgggcagtttctccttttatttctttatttaattaataattgtctctattattactctatgtgctccttaagggcagggaccattatctgtgctgctcagccttgaatctgtaacaccaaagtaacttaagcactaagataatcaatttttcctcttctttcttcctattaatttatttaatataatatctttattttaagcctcctctaagagttaaaataatgttgtagtaaaagaacacacaagaggtcgggcgcaatggctcacgcctgtaatcccagcactttgggaggccgaggagggcggatcacgaggtcaggagatcgagaccaccctggctaacattgtgaaaccccgtctctactaaaaataaaaaaaaattggcagggcatggtggcgggcacctgtagtcccagctattcgggaggctgagtcaggagaatggcgtgaacccgggaggcagagcttgcagtgagccgagatcgcgccactgcactccagcctgggtgacagagcgagactccgtctcaaaaaaaaaaaaaaaaaaagaaagaacacacaagacaatagggctgagtttttcaaactatagtccatgggtatttggaattgtatgaataaattgttggtgtataatgggggtcagaaaactatggcctagtgttcaaaacaacctgccacctatttttgtaaagttttattgcaaaatagccatgctcatctatttacacattgcttatgatggcttccatgctataacagcagagtttagtacttgcaacagagagtgtatgatttcaaatatatactatttgtccttttatagagaaaagtttaccaatccctgaggtatagaaattaaatgagaattattagatctgtgtgcttaggacaatgtaaaataatgaaggtacatttctaataatctagatgactaatagaataatccccttgaatttgatttttttgtcacttttaccaaattaagggtaaatgggataataatactctacaaatgaagacattgcagctgtttaaatggtgaaaagtttttggaaaattttggttatgatatagaacatagcacatagcactacagatgtatcacatagtactacagatagggcacactcccaagagcctgcatctttccattgaaagaggatgtgttgcaaaccttcattgtttgtatgcatcaacgtgcaattcaatagacataaaagtagcagtaaataaaaaacatttttttcagtgctgaattcttgggtgtttcattaaataataaaattgtataatggtgactgacatgagtatttctaaataggaaaagtgaagaaaaaatcctagtaatcactaatcacaataactcagacaatagcacatcaagctccaaataactttaatcaaatcagttattcaactgtacacatccatagctttcttttaataagtctacactaaccgttgagtttcagtgaaaaatcatttcttacactaatgttttaatttgaattttatcgattttatattttgtttgaagtttttgtctgatttggtaattgtataaaacctgtgagcctaaaaagttgatacccaattttattgttgggtatatgaaacaccgtaatattaaaaaaaatggttagtatgagagtggctccttataagaagacctgcaccttactcaattttgaagaacacggaatgcacctgctaccaggccctggatctactcctaaatgaagccagtcacaccaggggcctaagacactagacacatcttcccacagactgtccttcatcaaagataattttgcccaccagatacagccattcattcattttttccaccaatttttaggggttttttttgagcatttcctatgagctaaggttctaggaaaagggctgctgatagtaataggattcaacttctgatgcaggagcactaagtgcagcttgagaaacaggacagaaatgattctaatatgatgtgataaggacagaaaatatggtgggaaaaaggagagcactaactcagctcgagagatggcagaatgttttcacatggaggtgatgcactggttttcaaagaatgaacaggagtcatccaagtgaaagggagtggggagaaggaagggcattctaagcagaagtgctcaccccccggttttgggggaccagtgggaaatatgtcgagaaaaaaatctcacattttcttttttttatattctcaggatatcctgagatgcctaaaactaaattaacacttgttgtgaacacattagatgcagggaatggggagattcaagggaatcatattgctctgcgccttgaagaaggcgacaggaatcacccacacgatgaagtcagcagagtgtttgatgctccttccttgagtcccacccttcacctcggacaccgttttctttctgagtctgcaggttaagccgcaccccagggtgaaaatgaacatcattctgagactcagagcaggcgtcagggacagagaggagcctcaagagggcgctgctgccttcagcttgtggtttgacacaaatttcatctttccttccttcgcacgtctctttgttccagcctgtggcctgatcttgtagggcagtttactctgcttaatacgtgagtcaagattttgtagaagattccgccaaagactcaacaacataaagaaatatatatacctttcggtttggatatctctcaacaaaaccttctactgcttctcagccagccatgctgtctgcttcctgctcaggacttgtgatcttgttgatattcagtgagtaatgtttactcaaaacttctgagatgttctattccttagctttaggatgacctttaaccccttccaaactggagaccatgcctcttctattgccactataataaagtctttcccttttttaggaaggaccagtggagactcggttacccagacagaaggcccagttaccctccctgagagggcagctctgacattaaactgcacttatcagtccagctattcaacttttctattctggtatgtccagtatctaaacaaagagcctgagctcctcctgaaaagttcagaaaaccaggagacggacagcagaggttttcaggccagtcctatcaagagtgacagttccttccacctggagaagccctcggtgcagctgtcggactctgccgtgtactactgcgctctgagagacagagtgggagggactgcagcgagagcccagcacaaaccctggggaacgcaggtggggcctgggtgtgagccgctttgggagatgaatgaatatggactcttgttcgctgggaccccaaatggagaaaataatctcatatttctctgcatcaaagagcacaaaacagaaatgtgggcccctcacacatgggatgtagctcaccacgagaaacttttcctaatattctggagttctgtgagccttgtttgtcctttgtctctcctgcatgattctgtgagttttacacataaaaatgcaggttttgcagggcctgatgcttctttgatttctggggctctctttaagaaaaagaaaattaaattataaatttaagtttctaggttatgcggtagaaaggggccttaaaatcaaagccgaatatacttcatagtaaatctgcatttgaggttacatagagatgatcttctttaagactgaaatattataatagtcttagtttgtcctgatactgggaggttccctaactccaagtcctctttcccacggcagcactagaatcactttagctatcattaatatgagtattttcacttctatctttaaagaaataacagctttattgagatataatttgcataccttaaacttcattcttttaagtctacaattcagtggttttagtatattcacagttatccaatcattattgtgatctaattccagaacattttcaccacctcataaggaaactctgtgcctactagcactcacccccattcttttcttaccctagccataaatcaaataaaaatattgatttatgaggaataataacacaaaattttgatgtacccagtcttattgtaaatacaggacctcttatgaacctgtatctagagggatgaaacataagtcccaacatttaagactgcaaagagtttaatgactgtgatgcaggggacaaaagccagtggagattgaactctgctggtattttaacaggatttctcttgtttttggtaatgctttggttacaaattatatatttttgggtgtttcccatcctaatctccaccataattaatatgcatggattggaatagcaaggggattttcaagaacacacatattgagttataacagaaactcctgtctttgagcagtgagtagaatttctggaatttatttttgtttacacacacacacaaaatatgtgtgcaaataaacatgtaggtatttttctctggtgttactcgacatggcaaacactgaacagatttggtgactcaggaggtatgttgtgaaatcatttattaacaataaaactatttctttttttattatagtttaagttttacggtacatgtgcacaacgtgcaggtttgttacatatgtatacatgtgccatgttggtgtgctgcacccattaactcatcacttaacattaggtatacctcctaatgctacccctcccccctcctcccacccacaacaggccctggtgtgtgatgttccccttcctgtgtccatgtgttctcattgttcaattcctgcctatgagttagaacatgcggtgtttggttttttgtccttgtgatagtttgctgagaatgatggtttctagcttcatccatgtccctgcaaaggatatgaactcatcattttttatggctgcatagtattccatggtgtatatgtgccacattttcttaatccagtctaccattgttggacatttgggttggttccaagtgtttgctattgtgaatagtgccgcaataaacatatgtgtgcatatgtcttcatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatggtatctcactgtggttttgatttgcatttctctgatggccagtgatgatgagcattttttcatgtcttttggctgcataaatgtcttgttttgagaagtgtctgttcatatactttgcccactttttgatggggttttttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatctcatttgtcaattttgtcttttgttgccattgcttttggtgttttagacatgaagtccttgcccatgcctatgtcctgaatggtattgcctaggttttcttctagggagtttatggttttaggtctaacatgtaagtctttaatccatctggaattaattttcgtataaggtgtaaggaagggatccagtttcagctttctacatatggctatccagttttcccagcaccatttattaaatagggaatcctttccccatttcttgtttttgtcaggtttgtcaaagatcagatagttgtagatgtgtggcattatttctgagggctctgttctgttccattgatctatatctctgttttggtaccagtaccatgctgttttggttactgtagccttgtagtatagtttgaagtcaagtaccatgatgcctccagctttattcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctctttgatttcattgagcagtggtttgtagttctccttgaagaggtccttcacgtcccttgtaagttgggttcctaggtattttattctctttgaagctgttgtgaatgggagttcgctcacaatttggctctctgtctgttattggtgtataagaatgcttgtgatttttgcacactgattttgtatcctgagactttgctgaaattgcctatcagcttaaggagattttgggctgagacgatggggttttctagatgtacaatcatgtcatctgcaaacagggacaatttgacttgcgtaataagagctatctatgacaaacccacagccagtatcatactgaatgggcaaaaactagaagcattccctttgaaaactggcacaagacagggataccctctctcaccacccctattcaacatagtgttggaagttctggccacggcaatcaggcaggagaaggaaataaaccacgactggcaaagtagtaacaaagattgagactaaaagttttgccttcctgctagaaagtgaaaactccgtatggttagtttgtaccttgattctatctggagaaaaagacatatgtaagaccaaaaggtgcataactgtatcatcccatgtattcactatagctcataataaattgtaagtctcacattttccaccaaagatgaattaactaaccgtgattcaattttaccactgtatatttacagtccagtaagttatattgagacaaaattggtacttaggacagtctagcatcttccatctctacaggaagtatgtgacatgacacagtcaaactcatcatatatctgttaactatacttcctgtaaaaggcagaagcctcacacagcccagtaactttgctagtacctcttgagtgcaaggtggagaattaagatctggatttgagacggagcacggaacatttcactcaggggaagagctatgaacatgctgactgccagcctgttgagggcagtcatagcctccatctgtgttggtaagcgtgaccactagcacaggacttaggctcctgttagttcagaaggatgtggagagaggcagatctttttagtctaatgaggcttagaaagaaggggtaaagggcaatgaaatcagagcactaggtctgaagccacttaatctattttatccccagagttacaaataagggatcagtctattttttcctctttttcacagtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtgaggccacagtgagatgggtgcctgtgggagccctacaaaaacctcaacaagaggcagggctcctggggagagactctgtcacagacaggaagaagcaaggagggtctgtgtcagcacaggtggtttggcaaggaaacctgagttcaattcatgtacaatgtctagatataacatttattagaagcatgtgtatcttctattctttagaatagattaagacagaatgtatagcacatatttttatatcacatatagaattatgcaacaaaaagtgcaataacaaaatatattaatcttgtgttggttttattgagggtgggaaactatccaattatcttcagaccaaatggatgattccattcataagctgttaagtttttagaatcacttatacatttatgcattaattactatgtagaatgctttaatccaagagtaatagaaatgcctttcatcgatttttcttaagaatggtatcagtactcaatgaggtaaaaaaattaaatttaaacttctttccataatcatgccagcaacctcttgtatatcagaatagatgcgaaatgtttctcaaatttcctttctctggctcctctgtttttgtgacatgattatgatattttaaaagtatctaaatattttgctgtcatttagaggctgcctactaagagagatgtctaaggtggaaatttgtcctaacggattgaatatcttgctttcaccctttcccctttgagttctggccagtttgaagctgagaagtggttagggccagaattacagctgccatggcaaccagaacccacatggtgtgtccagtgtctacttcctgtctaaacacatatttctccttggatgttacaacaggtgctcaggaacaaggatttttatttcttttgctccacacaagtttttagaaacctgagtttttaacattaaaagaaaacagacatcacattaaaaaccagatttctagcttacctataaacatgggaagagctgggaaacactacactccctggggtagaagtcaaaagttctgtttggacacataatggttttgatgtatatgtattttatttttaaaatttatgcaaatttaccattcatttcacagtatgaattaatttaaaagtaaaaatttaaattattagttacaagacaagctaatctgcaagacaaacaaatctgaattaccatttcatgaaactatacctggttttccccccatgatttcatgtatcatgggtgtgtcccagcttgagaaccttaagtatagtttattcttaattcaggagacatttgtagctatagtaagcattggagaaacattagttaataagacagacatggctcctgcctttatggaggtcatgttctagggggctatatccactatagaatggtaggcagagggaactaaagttttacacaaacaacctatgtgaccttaagaaagttataactcccctgaacatgttctctcatttgtaaaatgtagagatttaattaggcagttgctattgaataatattttccaaaattttactagcctcacaagagcacatagtccactgcctttttgagttcctaacacttactagctgcccttcttttttgggaaaggacaattagttgttatagacatattcatactgttccacatgttgcatgataatgtaacagtaataacaagaagccaaaggaagcaggcagagaggagagtggcttgggaggtcatctgctttccatacacagaagctactgttctatgtagccgggcagcagaggaagagggagaggaagaaggcgagagggagggagaggagaaaagaaagaaggatgaggaggagaaggaggaaggggacaggaggaaggcagaatgagggatagagaagagatgaagggaggaagaaagaaggaggaaagcacagaacaggtactaattcgaaagtaaatatgtttatttgaattcgaagtttttgtttctttcacaaggcattagacacactttctttcctcagcatgagagaatgagaaaaattagaagattcctatttgacaagcatgaggtcacactgaacttggactagctggctgaaactccagaggacacagctcctccagttaagctctaaggcaggttgagagacagattttctagtaattctggttgtcccttgtaaaattaatataattcatctgttcctaaaggaactaagaacattgtaactgggaaaggttccttcaatattagagttctctctagagctaagtagcaaatgcaaatgctcataggtgcctagagtagaatgaaatgagtgtggttgtccaagtgtttaaaaaggtacaggcctgataatgtgtcactaggcactgggccttggcatcagatgataaacaaaaatgatgcagtaaaccctcccattcttctcctaagcagagtgggtgtcctgaaaggttatccagagattgaagctgcgttgtttgttcctgagtcctgtcaaagtcaggctacaagctgttagatgtagacaggccattgcacaagagcttttatacaggaagcttctggatgaggggctggggagatgaagccatcacagtctgcaaggcagctgaggcttattccagcctctgtgaataaagtcaatgataatgaccattaggctccagcccctgctatttcctaatgatccttatcagggaacctcttcaggtgttccctgaaattagtcaccctcataccccacatctcagagcctatgatcttgcatacgatggatgtcttcactgcagaattgttccagtatccctgggctaaagtttgactgagttcaaataaagcatatcacacacagagagagctggttaagctaatgagctgtccagggttatgtaatcacttggcttacataacttctggacatgatccattgtcataagcatttttttttaaaagaatgaaagcatatattaggcacatattatgtgtgatacaaagaatctctgaaccttacttcttatccctctttattacatgtagtagttgccttctccatgacccctagtacaacctgcttaccatctacatcctttgtgtgtttgccctcatttccatcttctacgacacaataagacacaagttcaacagctcagtgctgttccaaccccagatggtagcattaggagcctttccacctgatttcataattaaagtttccttttctttggaaaagaggaaatttccccatcagaattggacacccttgggagtgaacagtaaattgtcaaatatgtactctcccagaagtagagtggaattcttgatgtttcccaccatcgttattacacaacctccagtctctttcagaatttccaaacagagggaaaaactaggtggacttgaaatagtaactcaatccaacagatttcccacattagtgaaaaatagctttgttttctgttcactgtattaaacaaaatactgccctctagacccaatcgccaatttatagtaagtacaaaggacagcagaacatattaaacccatcacaaatatacagtaagcaaaatctatagtgtgaaaaactctgcaagacaaacaccctgggtctttttttcttcccacaataaactacaaagaatgagtaaggggatctatggattagaagagcctttaaaaaacatatcgccagaactttggctttcccagtgccccatgcttgcaccatgtagaagtgcaagcagacgaaacctcagcatgccaacttggaggaggaccagggtgagcagcaactgaatccagagttcgcagatgcagcctgaatggcgccagtggtgggggcccagggtgctccaatggatcaccaagggaatgatgatgaagcgaatgaggacaaagccatgtggtaaaatggcttcatcaggaggagatggacacctgtgagaaatactgtgcagagttctttagcgtctctgagttcttgaaacataagaaaaattgcactgaaaatccccctgtcctctccaggaatgacagtgagaggccatgacagctctctggagccagactgagccataccagccacccagtccaagtaataaagatggccacaaggagaacagtggcagctcaggggacatgaaagagaagctgggtgtggagtctgtggtgcacttacagacagagatggccctgccacccacacctaaggacataggctatttacccacacgcaaagtagccaacgctaatgtgcccatgcaggctctctggggcaccaaggtggcagtgaatctgtggagtgcaggtgcactgccagcctgtgcccagtgcccacagcatcccatgggtcctcgagcagatcttgtatctgcaacagcagctacagcagatccagctcaccaagcagatctacattgagatgaacgtgtgggcctcccacatcctccactgtggcagggcaggggctgacaccctgaagactttgggcagccacatgtccctgcaggtttctgcagctgtggttttgcttagccagaaggctggaagccaaggtccgtctctggatgccttgaaacaagccaagatactgcacaccaacatcccttctaccttcagcactctgccccaggactgatgccttttgttctgaagccagatgggaaaagggtactctcttccctttccctgtttgggaaaacatcatgtgtcccatactgagtgctttgctccctcaggctctgggcttggtgctcttccagggtactttctccactatggcattagacccgtccaagaaagggaaaggaaggctatggaacatctccaagcacaagtgtaagtgctctagcaaggtttttgggactgatagcttctcatggatccacctctgctcccacactggagagagacccttcgtgtgctatgtctgtagtcatcacttcaccaccaagggaaacctcagggtacagtttcacaaacatctccaagagaaggtgaacccccagttgtttgctgagttccaggaaaaaatggcaacaggcaatggcaacccatatgcactctgtacctgcccccatcaatgaatcgagcctctctttaaacagcaaacttgtccttgtaacttcctctctaaggctacctcagaatctctcttcagagactaacccgaagaacctcatggatggcctgttgcccaattacctgtagcccagtccttctgcagaaagtgagggcaggcctacactccttgaggtaaggacaaacaataattcaccaagtactggtggcttctaagtgagtgggacccccggccaggaccagagaccctaaaattgctgtagctgtttgagaacatccacaatgccgccactggcttcattttctactgattcctaagctatctcaaaatgtattactgcacatgcacccacacaccagggagagactattccagtataagatttgtggctgagctttttctaccaaaggcaacttgcagactcaccttggggttcactgaaccaacacacccataaagaggcagcattcatgcctcatctgccagagttaccaatgccgtgatattgcaacagcatattcagatgcacacgggcagtcagattcccaatattcccttgccagaggatccctgtgaccttatgatcctgatccaatgatggtcagtgaggatggcagtacaagtgccatctgctatgatgatgtccccaaaagcaccgatgtagaagtcagctcccaggagggcccaagcagctcctcaaagatccccgtatctccttccatgacggcttccttagatgccccaggtagggggagtgggtcctatcccttttggcctgcagtgccagagcagccaaaaaatggttcagtggagagcaatggcttgaccaaccactcatcctcactgaaatgagactaggagtgtgagagccaaagtccagacaccatggaaactaggtccttccaggtactctctggccaatagtgaggcacaaatcatcaagtcaatgtctcctgatgctgggggcaaatcagagagctttgagaacagatgcagggatggaaggttggagcaggctcccttcaacgtttatctgagcccagccaacctatgtcaaacttgaagttccaggtatatttgtaggaccctcaatcttgtctccagggatgacccctttgttagaggcccagctacactgacaggtcaagcaacacggctgcacccagtgtgggaagaacttcctgtccactagtcttttcagattcacagacagactcacactggagagaagccttttgtatgcaacatttgtgggacagcttttaccaccaaaggcaacttgagggtctactatatgacacatggggtgaacaataactcagcacaccatgggaggaagctggtcctggagaacaccatgtctctgttaggtacaaaaggaaaaagagtctcagaaatgtttcctaaggaaatcccagcccctttagtgaatgtggacactgttgtaaggaatcagtatacccccacacttgactgtggtctggcagtgaaaaccagtgagctctctctgatccagtgtagctgtattcctaccctcctggtttccttggaggctgtctccatcatgaataacaccaccatctccaagatgatggctcccaatcaggtgtcattgcggatgtggaaaaaccaggtgctattgacagcattcccaaacatcagttcctttacttcctggaagaaaacaaggttgcagtcttctttttttttcttttctttttctttttcttttttttttccagcttagcttaacttgcatggaaggataaatgcagacagagttaaatctctagaatctgcttttttttttttttgtaaaggcccatctcctcctgttttctttcttttttatttttatttttttcgagatggagtcttgctctggaggctggagtgcagtggcgtgatctcagctcactgcaatctccacctcccaggttcaagcaattcttctgcttcagcctcctgagtagctgggactacaggcatgtgccactgcatgcagctaatttttgtatttttagtagagacagggtttcatcatgttggccaggctgatctcgaattcctgaccttgtgatccacccacctcggcctcccaaagtgctggagttacaggtatgagccacccgcgctcggccttctttttcttactggtatgcaaatgacgtttatgaaggttgtgaccatcacctcaagcacaattgaaatgaaaatgaaaaaaatgaataaaaaattataccaaaacaaatatacactggatttttttttttaagcagcaggtgttgcaaagtagccttgttacttgtgacaaactatatacataggactttcgtaaaacctatggtgactttttctaagaccattatctacttcaaggtggaatcattggaacttattgaaccacagtggaagagacaactacttagcctaattggggtgaagggtattggtaaccgtatgcaggtaaacggacaagatctgtcatctatttagggaactgttttatattcccccaatcctgttaacatctttctttttctttctaaaaatatacttttaaaagaacaaaaaactaaggttgtacaattataaaattgcttcaaccttagaaccttaagtaggatgccctcagatggacttatgttagtgcttagggattcattgtgtgtgttgctgtttattcaaatgcagttcagtcagaaccgcaagagtgccaatgtcctcctcatacttcccaaatgcctttttcttcctgaacctgaggtggacacctgaatggggaatctcaggtgacttaatttagtttgtcggtgcctaccctattgaaaaaccgggttttcattcttgagaagaaactcatggaagggtgtgtttcctgccataggttcacacactatttttttgttttgtttaatttatttggtgcaacttaggaagattattttttcttgaggattttatgaaggctgtgaagttggaacaggtgagtcctgggtaggaaagcttttatttatctcccttatttatttatttatttgttttttagccatagtctctattttcctattttaagactactgaagtattcccaggttctgtcttaaacctaaaagtcagtgtattggtggaaagagttggatgttcaaggtgttttgtgattcctttatttgtaatctccttttgtatatgtaataatattgagcaaaggaaacatctctctaatggtttaacaagaaaggagaaagaaaaaccctaacttctgggagaagtctatcccttctatgtggaaggccctgaatgaaatgtagatcaagactgttagctaatgttttgcctcttggttattgcacctgattttaggcctttttatttttttgccatttgtgcctttccttctggaattgtaagtgaacacaataatggtatctgcttatactgtgaagtgtgtattgttacagagaccacaccagtggctttttcactgttgagctaataatgccttgtgaatgtatgatctttggagaaactcctgtagctgtgctgctaatgctgtctgtctgttggaaaataaattttgaatgttttctctttggaaaacatgtccacaaatcacaatatgtgactcttaggtgaattctgaatcagataagctgtaaaataattgaaaatgtaaacacatttaccaatttggttgtgttttaaaaaagtcaaaatttagtgatagtactaaaataagcaaaagcaaaataatatgatattttacaaatatatgaatggctttaaaaaaataaatgaatgagtaaatgtagttggggcataaataaaacaagattgaccaagaatcaatatttgatgaacatgggtgatgggtacatggggtttcattgttccatactgtatacttttctatatgtttgagaaattttctttaaaaaaattaaaaatagaaattggctagattcaaatcctgtcatctccattgcagcatgacttttgattctttaacctgttgatgtctcagtttcctcatccattaaatggtgataatagaatttacctcgcgaagtcgagttgagaattaaaattatacatatttacatacacctatatgtttaaattaaactatacatgattttatacagacagttttcgcacggtacatagcatggcatgtcgacgcagtagagactcaatctgtgacagccaatgttaatggaaagggtggaatttgttcagggcctaaatcagattttcaatcatgtgctagtttcataacaccacactgctccttgacacgtttttcaaaggaaagagccaaaactcattgataaggaaaggacatcttggcactgcttgaaaatcaccccaacaggtccctaaatccccatttgcagctccagtaaatatccccatttgcagctgctcccccaccagtacctaccctgctgctaaggcccaggccctgtcagagaagcagcacatgacggatgtttaacataaaagtgttttcagggggcaggcagggctgctttaattcccctaactaggtaatttaaggtatattttctcatatttgccaacagaccaaagaagaaatgctctaagatgtaatcaatattcacatcagccttcaaaccaatttgatttcagtctttcacactgttgaaataaacaaccctgtgaagtcccacacatcaagataaaagccaacaaagaaatggcatttttcccttgagcaactatacacctaaaagatgacttgtgaagcaataaatataggttatggagattttcccctcttactctaagagtacataaacactttaaaatgtatttgagatattattgattgctgaattaatatattttgtaagatgaggtaattattgacaaagaagatattctcatcctgtattcagtttaaatgcaagctgtcatacaaaaaagagatttaagaggagatttataacctgctccaggaagctaggagaaggtttcatccacccccaaagcgcagacacctcctcactcttctgcttgttcacagtaatatggatgccactgtgtctggtcacagatctatgtctctgcttaaattgtccccattgcacaaaatgtcctttctccatctccacagactaaacttctgtctcaacctcctatgactgtacttttggaaaggaaagtggggaacacagtaggtgagaaaagacatctgttttgctggttgataatctagaagatgtggtctagacattgaattattctcatttcataatttataagaacaactattaaaatgcccagtggtcctggataatgtatagtcaccattcttatcttacaagacatagctgtcctgatgtaaagatacaacgtgtgtaatctttccttctctaaacttctcaatcactctttaatctttgttgctacttaccacttgatatgttgcattttgtttctgaaaattcatgtctataactataccatgatcagaatggctaaagtgaaaaagactacactaaatattgacaagaacatggagcaacagaaattcacatattcggctggaaggaatgtcaactggtacaatttcaaaaacatttggcaatatttactatagctgaacatgtgcattccctgtgatgcagaaattcaatttctacctatatgcccaataagaagttacatatattcatttgtaaaacatgtacaagaataagaacatgtattacatcagtgattataatatcctaaaactggaaagcaactcagatgcacatagcagtttcaaagataaataaagtacgataatgaaatactacccagcaatgagaatgaataaacttgccatatgctcaaggcagattgaatcacacaaatattactgagtgaaaaatgaaagcaaaagaaattcaagaaaaggcaagactaagctatgaagttgtaagtcaggagagtgaagataggggctatctttacaaggagatagtgactcagaaagagtacaagggaggcttctggatgctggcaatgctgtttctcaatttgggtgctggttacataggcgatttcactgcctatgtatgaaaattcaccaagctctacatttaagttttgtgcactattctgaatctatattatactttaaaagtttttaaaagaaaccttatccatcccattgactaaattttgagaacatacttcttattcaatccatcttcatagccccactgcccttcacattagccttcatttaaaacatgcttcataattgttttctcaataaaggactgagctacatgtttaaaaagatgctccggtcccaggtcctaggatctagtatgttatcagatggacttgaacttccctgtgtagcttgctaattactgctttgagtttagacctttggtattgatgtggtttttctctgtctccactcaaatctaatgctgaattgtaattcctagtgttggaggagaagtctggtgggaggtgattggatcatggaggtggcttctaatggtttagcaccatccacctagtgctctctcgtgatagagttctcaagagatctggttgtttgaaggtgtgtggcacctccccctttgctctctctctctctctctcctgctgggcatgtgaaagtgtacttgcttctccttcaccttctgccatgaatttcttagtttcctgaggcctcccagccatgcctccagtatagcctacagaactgtgagtctattaaacatcttttcttcataatacccaatctcaaatagttctttatagcaatgtgagaatggtctaatacaagtatgttacacatggttttctgtaacaggcttttaactggcctccctccttccagcatttcctccccataatccactcccataccctacaaatgacttattcttttaagaaacacagcatcaatcacatcagtcctctgtttaacaaccttcaatgaccatccttttcctgtaggagtaaggttagttaaaactcatggtgtagctctcgatggcctctacagtagtcatgaactttctgcttcatcagattaagtctaacttgtgaatgaggctgggaaacatttactgtcctccattaacagctctgctcatagtcctttgctcccatgattacacctgtctgaatgcttaccatcattctttctcctgatcctagagactatctcagaccattattaccttgtgaagaattttctggtcaccccagctcacagtgatctcttccttctgataaattaccccaaatttttaaaaaatatatttcaaaaaatctttttttcaaaaaatatttttgaaatgtatttttatatattttatgtatgtttttaaaatatagttcacttaattttacagtgcacttttataagcattatctcattcactgtttataataacattgtgaacaaggcaaggtacaaagaattaatctcattttgtagcttaaaaactgagattcagagaagtgaaggggcctaagccagtgtgctcagccaagggtaaagctcactcttctcacccgagctctctataccaaattaccttattatgagtatatacgttatctcctcccaaatatacatttttttctaaatgttcttacacgtttgtatgtctcataatactggacaagacatttacggggctatgtagagctgagtgattttatttcaatattgttcccagcaagctcaaggactgacaaagctgtaccacctctgctctatgggactactgtagcaaaaactgaattgtagaaaaaaacaatcactgcatctccaaaaaatctgcttttggaagtaagaaagagacaagaaaaataatcttttaaaggtcagggcagccttaattttacctttatatcctaggctccaatattgaaaagtttcaaagaaggctatcagaggtaatgacaatgggcttcaagaactacaaatgaatcacaatgaaataagtttcaaattgatcaaattccagaaaccactcctcagataatttaactagtaagcaaaatggagaactttttgattttgaagcccagtttaacagaatttaaactatattaatataaaacttaattttctttattccaaaggctatattatactaaatctttctggaagctaaccacaggactaatgtgatgaaattgaaagaatggggaacaaactaggtggatgtctggacaccccaaactgaaggtaaatgctaccttctaccctaacattcttgacttccacaaactcaggtgttagacacctgagcactggaagttaaacaggtagatatgaagactaagaaaagaagagggagatagagggaccaaaataaatctgaatattgtaaagaaggtattcacacagtctttatttgcctagtgctaaatacatccagtgtctacttctagtctgacccttcattccaaatgcctgtgtctgggctaacgggagcatagacagcgaatagaatttgctttactgtctgatcttcactcaagtgaaagcaatttgaggcaggaatcatgttttgttttggtttatgtgtttttttgcagagctttacatgtcatgtaagtcggaatttctggaatgagtacttaagcttagggattcctgagcatgcataaacatttaagagcggctaggtgatctgtctagccagagaatcttgtcagcatgtaactgtactcaagaccacaattttactaagagttgaagtgtgtaggtaattttaactggtgagaaaattcatttaggataaatatttattatttgaagattatttttatgttcactttatttttgccatagctattgttactatactgacagcacttccaataagaacctgtgtaaaaaaaacaatatagtggtcctcagtaaaaaagtcccaatgctttaaaatggtttatgtaggcagagaactatgctttaacttcttactataatacaaccataacttgcataaagtaaatccaatcctagagcaattatgagctatgaattctgctggtcttatttcattagcacaaataattttaaaagggctagacaaacaggccaacagatgtcgagcaaacagaaactttaactgagattcctgaaatccctaataaaacaaataaacaggagacagccataataaaataaatgcctctgtaatgaagagaagtgtgtaatagtaagcatctaaacctggcattataaaagaaacaaaaagtaaaaagatggtgtttcgaaaaccaagttactaaagtaaggttacctatttatcataaggctaaaggtgtaaggctgctgtcatccaagtatgatccagggaaccctagacagaccttttagggagtctggcattccaaaactatttttataatgataataagacattatttgccttttttactttcaaagtctcgcaggtgtatatgcaaggtttccagtctacatggtatgtgataaggtcatcactctgatggttaatggaatatatctctacctctatctctatgccacataaacacaacctctttagagtcttcttggaatctctcagtgaaactataaagggatcctgagaccaacaagtttgagaactgatggtttacaggctacaaattcaatttatcacaatatgactttgaataatattttaccacttcacacacagtgtaataaatttacagcatttcacctccattctttgtgctattgttgtcaacacatttttattctacataagttaaaagccccacaatgcagttttatggtttttcctttaaaaaattatcttttaaagttttttttttagcacttcaaagtttggttctgacatacattgtttctgatgaaaagctggctgttattcttagctttgactccccatacctaaagtgtctttcctcatttttctatcctgtcaccccaactgctgttaaaattttcctttttattactggttctcagaaatttgattacaatgagccttggggtaattttctctatatttcttctctgtatctacgaaaaactttcagccattatttctttaagtatctttctttctctccctctcttcttctgaggcctcaggtacacctattttagattatttgattttgtagagttcaggagcactatttctttttttaaaatcttttttctttgcttcagtttagatcatttctactgctttttcttcaagttctctaagctttttttcctgtgatttctaatctgctgttaatcttgtccaacttatttttcattttatttaattgttttttatttctacaagttccacttggatctttttacgccttccatttttctcctccttatgtttctatatttttttacatccttgaattcatttttattgtatgtatgtagtttatatgcactgttttaaagtccttttataataatcacataatctgtgtcattttaaattctgtttctgtttatctttctcccggttatagactttattttcctggttcttcaccagcttgataattttgattgggtgctagatattatgtattttacattgttggatgcacaatttttttatattactttaaacaccattggacattgtactgattattaaataatttgcttatcattttgattttttgagacttcttttaatttttatctgaacagcctctattctgggactaattaaagtcactactaatttatcacctttctgaggattctagtgcctgccctgtgcattacaatgtctcttgaatcctggatgctagtaatacaaactatgcccagcactatgtgaactctggaaattatttggcctgttgcttctctttgcctgagtttcctctcatgtatgtacagatcagccaaagacaaagagtgacccctccagagccagagttctcttctgaatctctctctccccctctttctctttgtctctctctctttttctctctccccaaatccctcctctctggtacacttattcatacattctagatgctttaggatccccaatctcctattctattcctcaacacaacgaggcagctgtgctgtgttgtggttaatcctccctgtgctgttgcctagaaactgcctccaggaaataagtggaagaaatgttaggactcacttcatttattttcattatctctgtattatctgtagtccaaggtctgaaaatttcctttattttgtccagctttttaatttgaagatcaatttctgtagcagtgtacatttatcaaggaaacaaaagtcaaagtaatttatttgtgttgtattttacagttgtagtggtccatgataaattggtgaaaacactgattctttatcatagattatttgaaaagagccacattagataatgtttctaacatgcattatcatgtttataagatgacatgctgattgtgtcttggggacttaatagaactgattcagataaaggaataaaggagagtagagaggactttctaggcagatgttctctgtcccatgagaaccataaagacatgtgcaaggaggaggcctcagatttttctacttaaaagttgtgcctggaattatttgggattattatctgtacccaaggagaaaatgatgcgagtaataattgaacattgccccaattattgctgtgaatctataaaaaatgaatgtttagtgctttcttcttagagtcctattccattcttcttaggtatctaccttcccttcaagctattttattaaaaacagggtcaaggttctttttggtttttattttctccaagatggtggattggaggcatcgtcaacatgcttctcccacttgggaagacaaaatagtgtgtagagactcacactgtgaactttcttccaagaagcaacacaggaacttaacaagaaaatggaaagaaaccacataccctttgaatgaagcagcaagttggctgggcacagcggctcacgcctgtaatcccagcactttgggaggccgaggtgggcggatcatgagatcaagagatcgagaccatcctggccaacatggtgaaaccccatctctactaaaaatacacaaattagctgggcgttgtggtgcgtgcttgtagtcccagctactagggaggctgaggcaggagaattgcttgaacgcgggaggtggaggttgcagtgagctgagattgcgccactgcactccagcctggtgacagagcaagactccatctcaaacaaacaaacaacaacaaaaagcagcagcaggttgcagcctgcactgtgagctagttggaacactctaagtccccagagtgtgagagggttagaaactgcttctgggatatacatgcccactggggaacctggcaatccaggctacggggaaagacttaatcctaccaagccctagagctgatttagtgagccgcacggggtacatgagaaggagcagcattgggatgtgctttgcatgcattcccagtctccagtggggacagagagaagccatttctgatcctcacaggggacctcgcagacatctgccagctagctcaggtggtggttgagagaagctcccaactgagatttgcaatataatctcgagtggggataaactcctttagcccaaactcagggacaagcagaaagtgtactataaccatgagcacaggagctaaatgcccctgccttgcaggtggatcaggaggggcatggcctgaaaaccacagtttctgtctctatggggaagccttgtggcctggagaagctttgagttctgagggcagactgcttggaatctagctagctgctgatagtgaaacactgcaggtgtgagacctgccttgccaagtgtgtaggggctgagggaggcttactgctgcctgctactccccactccctatgtggaagagtccacatggggaagtgccttctgtgcaatagaggcagctgtactcctctgcttatgccagcttgtgcctccacttgtgccagcacgcagaacacggacttccctgacccagccccacctagctttgcccctccaccagctccggttgcttaacacaaaggtctgagtcttttaggagctatatcgcccttcccattgcctgagacaccaaagtacctctcccagtaacataaggcaagcacaaatcccaccattattaccacagttggtagtcctttgcaagcactatctcctggctggaggccaaccaacacagtccttcacagcatttgtagacagaataaaacagcaccaagaaagaggaaacttgagtgtgatctcaactatcaccattgcctgcagcaccctggctaaccaggaggtcctcagcatgtccacatgatcagttcgtttactagtataactggcatttgaggaagccaacacactaaagctattcataactaagcaatctctcagagtctaagtcactctcctgccactcccatcagagctagtgctggtagccacttccgggagacttgagaacaggtcacatcactagatcccttgcagacattctgcagcaacagcctggaggtatcagtcccactgggtggccagatccagaggagtagcagcattcacagcagtctggctctcagggactcctacttctaggggtaaagggggtgcactatatcaagggagcaccctgtgggacaaaagaacccagatggccggtcttgagtcccagaattttctgctttgcggaagtttctttcaacagagtcacaggtgcagtgctgagctcagcagggaaagcttgtggctctaactaaacagtcagtcagccctggtgctagtgaagggtcttgaaaagtagaattctttttccccctcatccaccactgcagacacagctggaacttctcccacggaagctcagtgtgggtgcatctgtagacaacctttccagaacacttcaaggtaattgcatccccacaggaaaaatgccttccaggtttagtcttacacaagggggagagtcacaatccctgtctacatggaacatcagcactcatgcaggtgagaagaggtgcctatacgatctgtatagctggaacactgggccagcagtatgactgggaggtggatcactttcctgctggactggcagggtagctgaggaggctctctccttccccttgaagaggactcagtgcatttcactgagagttcccccagctgcttctgtcaaggctgggacctctgcccacctctaaatattgcatttacccatctgctttagccacagttgtttttttgttccccttggacatctcttactggtctgaagcctgaactgttccacccagtgaataaaatactggggaaaaaaagtaaataaataaaagggtgcacaccactggagaatgagacaagcgtcaagacgcctctgccattcaagccccacaggagacaatgaacctgctcacatactgggaacattgctactacaaccagcatccaagaaagctgtcatacaacggctttctataaccaaggagctcatacagaattcatctctgaaagcacccagagccaaaccagattataataaactataatcaaagtcacatcctcaagggggcaaaaaagaaattaaaaaacccacaagtgagtaaaaaataagttaaaaaataattagaagaaatggtctatccaaatacaagaagtgcaaagaaccactgggagattcaaccatacacacaaaaatgtgacccatggtcgaaagagaaaactgttaataaacccaaaaagagatgacccaggtgttggatttattggatgtactttaagataaatataataaaatacaaatggatctaatagaaattgtagacaatatgcatgctgagatatgtaagtttcggagagagaagaacaaacatatgtatagggaataggttaaccagtatatttaaaaatatgtatacaaaatatgctaaccaaaaagaaagattgacaaataggacacgaatacaattttaaaatggtgctcatccaacgacagtattaagaaagtcaattagcaacctaaattctgaaaaaatattcaagaagatacagctgaaaaaatattacttccagaatatatttaaaacctcccataaattaacaattaaaaattacacaataataaaatacataaatggtgtaacgagtgagtactgctatagactgaatgtttgtgtccccccaaattcatatgttgaaatctgttgtgattttaatttatgtcttttttttttttgacggagtcttgctctgctgccatgctagagtgcggtgacacaatctcagctcactgcatcctctccctcccgggttcaagcgattcccctacctcagcctccaagtagttgggactacaggtgtgcgccaccatgcccagctaattttttgtattttagtagagacggtttcatcatgttggccaggatgatctcgatctcctgacctcgtggtccacctgcctcagccttccaaagtgctgggattacaggtttgagccacctcacgtggccaatttgttatgtcttcttaatttggacttgaagtctctctcctgagaatgaccataagccaagataaccactgcctaggacagccttgactaggggaaaaattaggtttaggtgtgtgggtcaggtaaaatggaatggatctttaaaacttcatgttgagcaatagaaaccaggccctcctcccaacatgctatataaggacgtgaagcgaaaaggcataaaatagaaggaatttatttctcccaggtcccagagaggttataggtgccagtgggaggctgatgggaagttcagaggcagcagggagctcaaccagtaggtgaagagagagagaaacagagggagagagaggcctgtgggattatacgtttattaaggttcatgggtattatcccttaggcttatccatgggtactgaggactgtctagttcaaagaaaacacataaaaaggggagaaattatgtacacgactctggcgttggccattagatttatcatggttagcagctgtggaaagtgttggattttgggtcagtgagatgaagaacaaccatacagggagtggaagttctaactaggccaagggagatgaagtatgacttatgtcaggcctgaaaatggacgccaaggcagcaaccacattaaacaaacttatgacagaactgaattaccagtgtggtcgtatttggaggtgcggcctttaagaggtgattaggtaatgagaataatgtccatataaaagaggtcacagagagcttccttgcttttttggcaatgtgaggacaccgcaaagatgactaccaacccgaaaacacgccctcactaggcactgaatcttctgggagcttgatcttggactatacttcctccagaactttgagtttctgtttttataagccacctatctatgatattttgttacagtggcccaaatagactaagacaaatctataaaatatgttaaacatcataagtcattagggggatgcaaataaaatctacattccggtgccattcatccccactagaagcactaaaaacaagccatctgacaaccccaatattggcaaatatgtggaacaactagacagttcatgcagtgctggcgagaatgtaaaatggcaccgcacaatcactttggggtcttgcaatggcccagcaagaacactcacagatatttagcaaagataagtgaaaacataggcccataaatgatccatacaaaaaattttgtatgcacctcatttatatttgttgtaactggaaacaatttaaatgtccatcaacaggagataaaaaagaactacggactgatacacacaacaatattaatggatctctaaagccttgtgttgagcaatggaaaccaggcccttccctcaaaatactgcatgataccttttatataaaatacaagaacaaaaactaaactatggtgatacaagtaaaaatgtggtttcctctgggaaggagagtttgactaaaaaggggcacaaagggatttttctgcgatcatggaaatgctctacatattgttttaggtgatagttacacaggtgtataaaattctcaaactcattgaaatgaatacattgtatctgtgcattttattatgtcaatcatacttcaatacaaaagaaaccaaaataaaataaaataacctatatagaaagaaatgtgcccctgcacaattgtagggctaggtaagttttcacaatttggaaaagcccatgtaaccagcacccatatcaagaaaaagggcattacccacatggcaggccactcttgtacctgcttcctgtctctaccagcccaagtaaccattatcccgacatctaactgcacagactagttttgcactttaattaaatgggatcatttagtatgtactctggtttctagctaattttacacaatcataactttatgagatgtatttgtattattatgtgtagccataaatcttcattctcagaactttggggcattttattgtctttggtcatttcatttgtgtatatttagcttcccagggcaaattaatgaccagctagtctttgttgattccaagtctcagacagctatcagagtagactataatcacgacagaccacagctgctctagcaattggaaaagtatagacaaattcctgcaaaaactgtagaaagctaaaaatattaatttttctctgtgtatatattattttattttggttcttttttatgaggtataattttttctacaatgaaatgcacttacatgtttagtttaatgtgttttgagaaccatatacacccatgtaacaagataatatatagaacattccctacatccctgaagtctcctttccagtctaatttttcctcctacagacaaccactttctgataattttatcactagttaaatcatcctggacttaaaaaaaattaattttctcataagagggactttaggtcattatattatattcaattatattcactcaaagaagagagcataaacagacaattaaaagctgcagtcaactgaatcacactcacatatctgcacattgacaccacacaaatcagtcaccaactttcatgctgctgaaaggtaaaactatagagttgcccccagtgaaaaaagtctttcagccacatctgccgcagcagtgggctgacagagggatttgcaatgttccaattgctttatttatgatataagagaataagaatgcatgctctgatgagtttggctgcactcatttagactatcgggtgcaatgtttgaaagccagatttttcctagcacagacttactattgattgctattgggcacatgcaacgggacaaattttgtcaatcaagaaacttgctgtaatgccattaagcaaacaagaaactttatctaatataaattttcccagaatccaatggcttggtgcacaggaagaaagagttataatgattgagagtgaaaagttttatctccctgtctggaagaaaaatctgggaatatatttcactgtagatttcagccagagaccaaaaagcatacaccatgcaaaaagatggatgataacttgttctcagtagtcatcataacccataataaattgttatttcttatgaaacttatgagtctatctctgatgcattggctgaatgtagcaaatggttgaatcattaaaaccttcaatttaatttaactcatgtacatgtacagatataatttctgtctattaaattaaaataagaccaaataggcaggttagaatctccaactgtgtcaaaaagctatggcttaacacaggcaaactgatatcagcagatcacattttctcttctggcagaggagcaccttacagctcggcactcagaagaacttgcaacattctgctcccctgcctactgaggatagtcatagcctctttctgacaaaggatggtaaagatggccacaaatgcaggactccggcttttctcagctttaaaatctgggggcagcagcaggttgttattttctcctaaacctgatggggtttaggggaaagaggtaatggacagggagtcacagccccgtcctacattatttccttacaacctcatgggtacccccaggagaatcagcataattctctctcccttccccctctctcatctcttttctctctctttttcaggatctagctagttccagagggtaactcaagccctgaccgaaatttatttttatgctttaagttctgggttacatgtgcagaacttgcagttttgttacataggtatacacgtgccctggttgtttgctgcacccatcaacctgtcactcttctaatgttatccctcccctacccacccaaccccaacaggccccagtgtgtgatgttcccctccctgtgtccatgtgttcttatagttcaactcccacctatgagtgagaacatgcagtgtttggttttctgatcttgtgatagtttgctgagaatgatggtttccagcttcatccatgtccctgcaaaggacattaactcatccttttttatggctgcatagcattccatggtgtataagtgccacattttctgaattcagtctatcattgatggacatttgggttggttccaagtctttgctattgtgaatagtgccacaataaacatacgtgtgcatgtgtctttatagtagcatgatttataatcctctgggtatatgcccagtaatgggattactgggccaaatggtatttctagttctagatccttgaggaatcgccacactgccttccacaatggttgaactattttatagtcccaccaacagtgtaaaagcattcctacttttccacaacctctccagcatctgttgtttcctgactttttaatgatcaccattccaactggtgtgagatggtatctcattgtggttttgatttgcatttctctaatgaccagtgatgatgagcattttttcatatgtctgttggctgcataaatgtcttctttggagaagtgtctgttcatatcctttgcctaattatttgatggggttgtttgcttttttcttgtaaatttgtttaagttctttgtagattctggatattagccctttgtcagatggatagattgcaaaaattttctcccattctgtaggttgcctgtttactctgatgatagtttcttttgctgtgcagaagctttttagtttaattaaatcccatttgtcagttttggcttttgttgccattgcttttggtgttttagtcatgaaatctttgcccatgcctatgtcctgaatggtattgctcaggttttcttctaggatttttacggtcctaggtcttaggtttaagtctttgagccatcttgagctgatttttgtataaggtgtacggaaagggtccagtttcagttttctgcctatggctagccagttttcccaacaccatttgttaaatagggaatcgtttccccattgcttgtgtgtcttgatgggaatttctatactaccaggagaatcactataattttctcactcttcttctcctctcctctctcctctcctctcatctcctctcctctcttttctctctttttcaagatctagccaatcccagaaggtaactcaaacccaggctgcaatttctatgctgcagaaggaggctgtgaccttggattgtgtataagaagctaaaacttaattattatttactctggtacagacatccaccaagtgggagaattattttccttatagatcaggagtcttttaatgagcagaatggaacaaagggttggtattctctgaacttgcagaaaccagccagttccatcagctgtattttcacagcctcacagcttgaggttttggcaatgttctttcatcccctgagtgaaactacagtgaaatattcacctgaggggggcctaaaaaattcatatctcaatgtcccccgatataaacacctgggcaagagtcacagtgtgaacaggaagaggcagggaggcactgtcaatggagatggagatttaggagaaacttcactctaaggaaaatgttctctctggctcagagaacatatcttaaattgtcattaatcaaaagcgtgtttatcttcagttctttatcttgaagtagattattcggcaaaagatatatatatatgtgtgtgtgtgtgtgtgtgtgtgtgtgtgtgtgtatatatatatatatatatatttttttttttccaagatggagtttcactcttgtcgcccaggctggagtgcaatggcactatctcggctcactgcaacctccacctcccgggttcaagcaattctcctgcttcagcctcccaagtagctgggatacaggtgcacaccaccatgcccggctaatttttgtatttttttgttaagtagaggtggggtttcaccatgttggccaggctggtctcgaactcctgacctcaggtgatctgccagcctcagcctcccaaagttctgggattacaagcgtgagccaccgtgcccagccaacaaaagattttttttagaaatttgtggtgactacattaaagtgtgaaactgactcttaaaaagttaagaaacacttggccaaatccatatgcgaattgttagatgatttgtctgtatattgccatgacttgctcttcttctttttatatttttttctttcccgttgagtgacctacttgatttacttaatttctgggtggatattccttccattacaagtcctagcctaagacttaaggaaaatgagcttgcttttctactttcctgactctggttccaaaggccgaattatttccattggaataaaaacttcttgattcttaacccttaaggagacttttagaaagtattatcctcaattgtaatattggtcttttcaaaattcacccatgagagcaaaatcaggaccctgttctgggaagaagcatgactacgtcccagggagccaggccatttggccatgaaactgtgattgtgaaaagacgtagatgaaagcatatgactttcacaaaaagtaatgacaagaagagggatttcttattcttgggacaatttggagagaattagtcttttcttcaggaaacatgtgcctaaatatcagaaaagaagtcatagaagaagaaagaaaatctcgttttcagttcattttgatgacttaaagatggatgggcaattttcctggggaatattaaggtttaaaagaacataaattttaggaaaagtttccagttattctcaataataagacagatataaaactattttccaaatctataatacaaaattgccctgtgataaatgacaggaaatttccgaaggtgatgggttgaaaacggtgtgatgtggtccctatatttctaaattaaattttcaggtagaataatcatagtgagataaaaaggaaatttttcagcctcaaaatataaaaggttttaaagtcatctattaaaagtctttgatatacattttggttattcaaagcagaataaccactgtacaattccatttatataacattcatgaaataacaaaattgtagggattaataacagattagtgattgtcaggggttatgactggggagaaggaatagctgtggctattaagataaaaataatgaactattcctcctatccaaaaaatctatttataaataaacatcataaaaaataaactcaaagtgaatcatgaaattaaatgtaaaatgtaaaactgtgaaacttttggaaaaaataaaatcttcaagatgcagagccaagcgaagagttcttaggtttgacaccaaaagcacaatacacacacacatatacacacacaaattggatttcatcaaaatttaaaacttttgctctgtaaaagatcctgttaagaagatcaaatgataaactacagactgggagtaaatatttaaaaaccaggtatctgacacagagttgtagctagaatatataaagaattcccaaaatgaaacagtaaaaaaaaaaaaagttagaaaatgagcaaaaagcattaaacagatttcactttgaggatatacatattgcaaataagcatatgagaagatgatcaacattatcagctatcagtgaaatgcaaattaaaaccacgatgagatattattatatacctatcagaatggctgaaataaaaaataaagataacatcaaatgctgttgaaaatttagggaaactggatcactagtatgttgttggtagggatataaaatgatacaggcactccggaaaatagtttagcaatttcttataaaattatgcatgccttaccccatgacccagcaattacactctttgggacttatcctagagaaacaaaagcttatattcacaccaaaacctgtacatgaatattaatagcagctttattcatcacagcccaaatctggaaacaacccagatgtcttccagtgggtgaatggttaagcaaacagtggcacattcataacatagtctattatatagcaatacagaggaacaaaagcatttatacacataataacttgcatagatatcatgcttttatccctcatgcagagtgagaaaagccaattttaaaaggttactactgtacaattccatttatatgacattattgcaataacaaaatagtaggagtaagtaacagattagtgattgtcagggattaatgatgtggggaggggatgggtgtggctgtgtgaaggagtagcatgaggaaagctgtgattgtgaaaccattgtgagtcttgattgtggcaatggttacatgaatctatacatacgataaaattgcatagaaccatacacatacaaattagtgcatgtacaacttcagaaacctaaataagctctacagattataccaatgtgaatgtcttggtttagaaactgttctatagctacacaagttgttatcattggggatgctaagtgaagaatacgtgagacctctatatacattttttgaaattataatactataattatttcaaataaaaaataaaaatatttttaaaaattaaacaaaactttgcataaaactcacaattctaaatcaccttctgtggctctgttacccatctatcacacattcagtctaggttctcttagttcctgcactaataaatataaatataaattgtccctgcattataaataaccctgccccaatcttgcgtttatctttcgtctttttcgccttttttcttaggtacatatattcagaaacagagaaaaactgcctattgaaaatgatttgtaagagtcagagtttgctaatgtgggtaaaataaatcaaatcagtcaatgataaattatatgcaagctagtgtaatgatttgtagataactgagaaattatcttattctcaaaaaaagtcaatgaacaacgtgtttatactgttagtacagtatatgctcggtaacttttttttctgctgaatggaagaagggttggaggagcatcaaagttaatggggactaggagcagactgctattggcacaaatccaaagagaattcgtgtaagtgatagataattcaacgagatgagcacatatttaatggcaaaatttacctacaaaattattggcatatgataaacacatctcaattataaagtccagtggtgtgtcatagaatcaaactaattaggcaatactagttttgccatgatatcttagcctagtattgctaatttcaatgttcttggaaaaacagtttaggagttatgtcagaatattattgaggttaattttcattaggtacctactcttttaattcagcaactcttatttttatagtagtgggtattgtctaaattatgattaccttgaaatttttatacatttatttgaaactagacatgctcactcaaaaatttcaatgaagactaaacatgtagaaaacgagaaacagtcttaaaacagaagggcaatagggtggagacaagttcgatcatacattaaataatattattaagctgaaataattaaaaatagttggcaatagtgaaagtataactagatagattgatagaagacagaaacaaattacatagagaaaattactgtactgcaaagatattactaatcagggagaaaataatagatttttgagcgcataatgttgagtcaattgtctagccacttgaaaaaaattaaccccttaccttattccttagatcaaaataactccaaatgataggcttaaaagattaaatataaaacataccagaaattttcaggatttaaaaaagtaagcttagagtgggtcaggttttctaagcaagaccaaaatttcaggagacattataaagatgaatgcatttgaatataccataaggaagagatatatgaaagcaaatatttctacgtggcaaaaatacaataaaacagcaaaaactaaacgccaaaatggaataaaaagcttcaaaatataaagtcacataaaacgtgactttaatatataaagagctttagtaaaccaacaaaaaattaactctccaaaagaaaattgtgctaatactataatagctaatgttacttatttgttacgtggtagccactattttaatttttatctaggtagtgtgtaatctacctgtctacctatgcatctatcattatcaatcaatatatatctgttggtttcaatacatatttcaagtgattctcacagtaattctttaaggtttgtactgttctttctccaccatccaatgataaaactaagctcaaagataaaactaagtcacagaaaatctctgagcaattttttcatagaaaataaatcatagagctagagtttgatcactggtattctgtctccaaaatgaacacttaaacataattttcaatagactattcaaagagagacatacaaatggattttaaaattattttttcaacccaggcttcagtaataatagagaaaattttgaaatggtattctgaattagcatttttcacctattaacttcagaaagataaaaatgtttaataatacattgtgttggcaaggaagtgaagcaatatttattaaatgaaaaatgcatgggttctctgttatcatttacatattttcaataatttttataaatatatttgttcatgttggcaaacatctttttatggggataaccatttcagcataatctttggtagtaaaagactggaaatgaaaatacaaaaatgcaaaactgtttaaatataatatagtacagccaaacaatggaatactacgtggccattttgcatggacaaaaaacaaggcacagaatgatatgtatgtttgtctgaaaataatgagtatgtacgtgtatgagagtgtttgaaagaacagatgcatagatgcctctataatgagaactgtgatactgaaggacagatgaggaggaaagacttacttttgctgtgtattatttatattgtgtaaaatatttataatttgcatggaataatctccctcgccacacacacacacacacacacacacacacacacacacacacacagtgactttcaggtctctctgaggtccagaaatggagacctcttttttctctctgttatgctttttcaaaacttccttccttctaatatctaccaattttgtgaccctgaattttggtcacagttggtctcaatcctgtagtcacacagaaaattatttgaagacatggatttcttaatttatgttccaaattctctgcacattgcatcagagaggtttctagacacatccacaagctatttgatcccctcaactccatcttttattttcagagctctagtctttttaaggtttcacctgctgaggttttgaggttttaaggttttaaggtttcacctgctgaggttcttgtgcattctagtgaaaaatatattttagtgagaaatataattacagctaccagtcggattcaactcctttgtaacttctggttgcagcttagctttaaaaaccattcaaaaaacaatctagagaattaagagtccaagtaaaataaggcttttctcattgccactttaaacctcatatgcactatgcccaccaaatatgaagaatatttttctttgtaggtggcataaagtgggtaccgtgggacagtactgtggccacgaggtggcagtggttcaatttactctcattctacaactgcctttaatttcaaaagcatgaaaattactagaggacttgcatttgattggttgagcagccaacagaaaggctctttcctgcattacagaatatgaactaagatacagaagtggcgcctctgagaaaagaaggttggaattatcgtaatttgtttctaggctgagataccagcatggagaaaatgttggagtgtgcattcatagtcttgtggcttcagcttggctgtaagttggaggttaagaaatgagaaccattcgtgcaaagctgaggaagagagatgaagatttaatctcagctcattcagttttcctgttggaatttttcaaagctgctaaactaaaagctttgtataatttctgattttgttttcctgaacagggttgagtggagaagaccaggtgacgcagagtcccgaggccctgagactccaggagggagagagtagcagtctcaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcacagcgttccccaggcacctgcaacttgtatcaaaaccctgcagctgaggatctgaaatgatggcagaggtatctctgctgttcttcctcttgaaggagtatttatttaatgcccaggacctttttccaaatggtcctttggagaatgaagtcatgagacaaagccagagggcagggactactgttcattctgtccaggcatcctagacagtcccttgtgcatgttcatgggtcagtctactcttaataacatcccagaacttccctcacataaattcagaagggccagatgtaatatgaagagtcctggtttccagttgcggactacttggaaaaagactgcacaggtgcatacactccctgccgaaaaaaaaaaaatgtgtgtatgtgtctgtgttgtctcacaataatctggtcacgttaatataagtaaatctttttcattttaatatagtcttcttgaaacccacatctccaccagccacatctctatatttctcatcccttcatcatcaaattacttgaaagaattgtctggactcattctcttaatttccattcttcagtctcattcaaacctggcccctgttagcattactccaagggaagttctcactttaacaccagcggttttggtattgataaggctatcagatatttttcagtactcatcttgtctaagatttgcagcagtctttcctcccttctcattaaaataaatgttactttaatcaaaataatactcacatatatttacaaaactcaacagcactgtctcacaccccagtcatgtctctccattctcaggtgatggtactcacatttatctgaacatttaaagatgctgtttcttcgctttcttctctttctttttgaaattgaggtacaacacataataaggtgaataaaactttagcttacagctcaatagaattttacacttctttgtatctgggtaacaccatccagacctacatattgaaattttccattactccagaagatttccacatgccccttccaattcaacggcccttccccaactctccacctggagtaaccatgattctgcctttcatcacttggtcttacactttgtgtgactggaattatattgtgcagcctatattctactgtctcaatttcttctctcaatatcatatctttgaaattcattaatgtttctgtatgcatgttattttaaaatttatatgtaaaattcccctgtataaatatgtaataatttatttttccattcttcttgaaatagacttttgggttttttagactgtttacagttttgtgccattatggaaaaggttgctataaacatttacttaaattttatttggtggacatataaactcactattcttgggtaattccactggaatggacttgaatggacttaactaggccataaaataggcatgtatttagctttagtggttattatcaaatgtatttcgaaaggctaccaagttgtatgctcttatgaacaatgtatgggagttttagttattccatgtcttcaccaaaaaatggtatcaggtttctttttgtttgttttttaatttaagccattatggtgacatgcagtggtatctcataaaattgtggttttaatttgcttttcctgaagaataatgatcctgagcaccttttcatatgctcattgtccatctggatattcctttctgtctagtacctgttcaagtcgtttgcttatttgtttattgttcatatgtaggcattcttcatagattctggctataagcccctgtcaaaaccatctattgtgaattctccactaatccattacttgactcttcactttcataatgattttctttgagatacagaaattcctagttttggtaaagtccaaataactatttatttttctttattggttagtagtttttgtgccctattgagaaatctttgcctacctcaagtaacagacacactttttttcatgtaggtccatttgccacctcaaatcaattttcgtgatgctatgcaaaaggtgtccaggttcctattgccccatgaccatttaatgaaaagatcttcctttcccccactgaattgcagtggtgtttgggtcacaaatcaggtgatcctacgtgtatagctctatttctgcactctattttgtttcttctgttagttcagcctcccagctatctcataatgtgcttattaatatagctttagaatagaatttgaaactcatcagtgtttttcttcatctgtgttcttccccttattattttatccattctatgtcctttctgaatccatacaaattttagaactagtttctaaattctaaatcattttcacatctacaaaattgcccttgcagttttgattggtattgcattaagcttatagataactttgaggagaattgctacctcaaaaatattgagtcattgtgtcaaaaatatagactatctacctgctaaggtcatctaatgtcttaagcaatgattttagttctcaatgtagtgatttgcacatcctgtatcagatttacttccatgtatagacatttcatgcagatttaaaaattttattttctaattgttgctagtgtatagaaatacaattggtttttacatattgaccttatattcattgaacttgctacacttactaattttaatcatttggtcatacattattttggattttctaagtccacaatcatgccatctgcaaatgaagaaaaatttgtttcttgcattataatctttgtatcttatttattttcctttccttccttattggccagacttagtggaagagttggccactctatttagatctgcttatcatcccagggaggcagggacttaaaaatgtaaaagatataaagtgagcgagtggtttatggagttctagctattgagtcaaagtaatgactaatgccctacttataaatagactctaaacaacagcatcggctctttccacctccgctttgtgtagaagaaatgcagggaggcctagaaaaaagggagcagaagtagaagcttcctgatttaggaagagaggcacaagtgttattttacccacgtcatctggttttgttgtatttaaccctttgggtttacagccttacagtttgcccaatgtgttcaggtgaagcgatacaaaaatcaccgaaggattcctgctttacctggtaccaattttgtcattctcatcatcatctttatcgtcacaaaaactatgaagtaatattaacccatttctcagattgggaaactgaggcttacataagttttgagatgaaagcatttctgagataaagtaaatgctgcaggtaccataaaataagacgaagaaaaacatataaaacttcagagttaaccaactagacagcacttctctaattttactgtacatttaagaatcacatgaagagtttattttaaaaatgctttatttccatagattctgattctataggtctgatacggggtcaggagtctgctttttttagtgagttgtctaatgattttgatcattagatctggagatcttactttgaaaaacactgcaactgggagagtactgcatttcaggaggatggatgatatagacatgcaggtgattttgtgttaacttagataacagggcttagggaaccaggaaacacacctgggaatgccttaatgtgggttatgcctattctgattaaactatatcctatcataattagtagaagatactttgttttgatgataaagaagggaatgatttttgtttcaacaacagaaatttatttatgatttgaaaagcagcagagagattaggggatagacaagccttttagttgcagactttccaagaagaaaataggctaaaacaatatatgagattctccactatgaattaaactttttcattctttattgtcaattaaaaaataaaacttctatatattttaaaggccataaaccaattatcttagtgtttccttcaatgttctaaaatttagacaggttttatctaattattttatttactctttttactctgcctggattctttacaacattttaactttctattaaagaaagttggttccaatactgttaaggctctgtttattacataatatagcacaatagtgctctaaactccacctttaacatgctcatataattccagtatagaccatgctaatactcataattgtttaatgaccatggttaatcttctgctgcatcctcatagccaggctttccttttcctgaatccatgatgagtttggttggtgtgaagactgtaattgacttttgtccccagagctcacctaatattatattcctaatattattggaatacaaatatgtctatttacatttatatatttataatctatatgttacacattacacatttatatttatttatatgttatatgacatctaattattggaatatatttttattttgtcttttggagaatttgttatggaatcaaacagacttatttttcccatgagatcaataggatatattgtgggacattttctgttacgaatttggcaaataggacccaaagctaggaaccaagattcattaggcatccaccatttttcattaagaatggctcacattttaagcacagctgcacttctcaaaaaatttttttaaataaaaaaattaaaaaaagaatggcccacagttggacattctctgtagaggtaagaagcagcaactgaacaggctctgcaacctccaattctcacctcttagctggtgtgaggaggtagcgagggatgggaggagtcaagaagagaatatcatcagagtattccccctttcccacaagccacttgaggggtcagtactccaaaataattacttccaaagacagagatctgctgcataaaaaggaacattgtgtgacattttcatctttgttctgaagcagattttaatctatgtttacatctacttaagaagaagacgaggaaactggagagagatggtggagtggagagggggcagccatggcctgcctgggtttctgcactgggcatggtgaggaggcacgtgtattctgtgggcaggtgctgcctctgaggtgccagggctgagctgtcccaccagagcttcacccagaggagaaagtaaggggctgtggagggttctcctgagggaggggctgacaggaaggggagacacctcccttgaggagcccctgaggtcccctgggtgctctctcatagggacactcaccatacacagccatcagtggtcggccagggaagcaacaacactagaggtgcacagtggttaagtaagaacagttttgttgtttcttccccttaatcttttcctttcaccttaatcccgggaagttaaaatcaaagaaaaaggaggaaagaagagaacaaagtaggccatgtccacctcactgtagctcgggatcaggcctgaagtttggagagcagaggaaaggtgaagactggagtgttaaacagaactgccctgaggtttatttaaccactgaaagtggcccagaggtttggagctttctttcctagacctcttcaagggcataaggaccagggcccctctgaaggacccaaccatgcttaagcctctttgatgctcttttctttggcatcctttcctctccctatcgctccacccagaaaatgtttatatagactctggtaggcagacttgcattatatctttgtatcatttcctataagtcagtttatgctggattccttaatttgcctataaagctgaaagttttgaaataagatggtaggaaagacttctttatttttggtttccagctatgcctcctttcctgaaagtgataagcagaaaatcacccaactgcctcaatggaggaaaaattgtgaggttaattaaaaataataatataaaaaggcaaccactgttaatattgaaaaatggcttgtcacacatggtgatcattctgaaaccacaaatgaccaaaactggtgaagtcctttctgtaacatcacaggcacgtctaagtgattcttttccatatctgtaaagtaactttacgaaagcaggtgaagacctgcccaggacctgaatgaaagcattcatgtatttagtcacaagagggggctgctgtgtctgtcaataagatgcctgttcagctggggaaagagtgtttggctcacagtcagtagtgaagccgtgcagaaactgtgacaaatgatactctttattctctttgttctaagcagagtagtctgtgcatagcttccaacattcaataattcctggccttgcctcaatccattatgaaaagttttgtttctactcaaaataggacaatatagaaagacagagacaggaagtagttatacagctttcaagttgaattgatcttttttttgtcgtttttgaaatagagaaaagtagatatttttggtggggaagatacttttttttctcaatctatttcatttctcttaaacttgagaagataatgagaaaaagtcttctaggttgctcccttccttcttacagtcccctcctttcttctgtctttcctcttctctgcatttcaattcttagtgtgtgtcaccactaggcacacacatggagaatggggaaaggtgggtcagggatagggtttctggggtgtaaggatgtgtgtgaccccaagtctcttgtttcctttgtaccaagatatgcagtctgtaaatgctctcctagagatagatgatatctagaggcatttcaggcatctggagacatggcttcctgatcaggttctgattatacttttctggtcactttggacacattactgtctgcgtctgagcctcatttcctctttattgttatttagatgggctttctccatcttcttatgatggtataagccttggtagggttttcctgaatataaagaaacttgtgacagagtggactgtactcctgggtaagagtttcaggcctaagaaaagatggtgttctaaaccaagaaatcagaagaggaacctgctgcctgcactgtcttactctccttcacccaagatgctaagggcaaccaatcaaataacagctgttaactttttgaggaggtcacatcctcagtgtgaggggctacatcatacccagtatattagtttgtgccataggctggggacttaaaaatcagaaatttattgtctcatggtctggaggcaatgtctgaagtcaagatgccaacagaatccaggaaaggaggatctgtttcaggcttctctcttcggcttatagatggccatcatatccctgtgtcttcatatcatcttccgtctgtgtatatctgtgtccaaatttctccttttatattgcattagatcccacctcattttacttagatacctctataatcaagaaataatcttgaacccaactccaaataaggtcacattctgaagtacttggcgctaggagttcaacatataaattttagagggacaaattttagcctataaccctcagtgaaagctcacagaagagttttctttgctgtagaatttcctgttttattgagcccaagggaaaatgacagacagatccagggagtcctgcctcttaactagtgagtctacatgaccccagccgtatttggctctttctaggggaagggagtcatacataaaattacttctcagtactataccaggggtcttcaacaagttcatgaaaaatgcatattacaaaaaaattatgcataatttttaaatttttgcatcaaaataaactcctactaacttgttatgacattgtacacagtatctaatttgaggcactaagaaggatgaaagacaaaacagtgtgaaaagagctcctgtcagagcaacgtgaattctgccaatattgaagcaaaaacaagcaccaaatttaaggtaaagcttgggtggaagaatggtgaaatcattgacaagtttatgggggcaattccccaaagaaattagcagtttacaaatgaataactcattttaagaagagacaagatgatgttgaaaatgaagcatgcagcagcagagcatacacattgattgagaggaaaaaattcatcttattcatgccctgattgaagaggactaatgattagcagcagaaaaaatagccaacaccatagacacctcaactggttcagcttacataattctgacttgaaaattaaagttgagcaaacctcccactcagtgggtgccaaaattgttgcacccatatcagctgcagagaaaagcagacatttcaatggaattttaaacaagtgggatcaagatcctaaagcattttttcaaaggattttaacagaaaatgaacacagattcaccagtacaatactgaatacaaagtactgtcaaagcaatgactgccaagaggtggaagtggtccagtcaaagcaaaagtggactggtcaagagcaaaggctgtagcaacaggtttttttgtttgtttgtttgttttttgttttgctcaaggattgttgcttgttgactttctggagagctgaagaatgacaacatctacttattactagagtgttttgagaaagttagccaaggctttagcagaaaaatgcccagaaaaagctcaccagagagttcttcaccacgacaatgttcctgctcattctttgtgagagtttcaatgggaaatcattaggcctccatctcacaatactgactttctttcttctgacttatttttgtttcctaatcttaaaaaaaatctttaatgggcacttactttttcttcaattaatatataaacaaacctgcattgacatggttaaattcctggactctcagttcttagggatggactaaatggctgatatcatcacttaaaaaagtgtcttgaatttgttggagcttatgttgagaaataaagtttatattttttaattgttaccttttaattccatatttctataaactttttgaaacccccttataccttgatctgaaaaatctgccttgatttgagggtctggggataatctcgtttttctcctcagggattatgtgtaatgttaaagccacaaaagtagggcagtgctgaaacaagaagtgaatataccctgttcccactctaccactggaggaaatgaggacacaatctggtatcaacagtttgataaccatggctcacagtatctgattggaggtttaaagaacgaggtgaccagtcaaatggcttcactgcctgtattagtctgttctttcattgctataaagaaatacttgagactgggtaatttgcaaaggaaagaggtttcattggctgttcaggttccgaaggttgtacaggaagcgtgttgttggtatctgtttggcttctggggaggcctcaggaaactctcaatcatggcagaaggtgaaggcagagccagcacttcacatggttggagtaggaggaagagagagaggacggggaaagtgccacacacttttaaatgaccagatctcaaaagaatgcactcaccatcacaagaacagcaccaaagggaaaatttacccccatgatccaaacacctcccaccaggtctgacctccaacattggggattacaatttgaaatgagatttgggtggggacacagatccaaaccatatcactgcccattcctgtggacaataaggctagtaccctggtcctgcaccagataaccctcaaaggcaccaccatgtgttactacactgtgggcagattggaccacatctgtctcccaggtgaagaggggagataaaatccatttaaagagggcattgcccaagaaaatgtgagattaatggaagaaggtagaaaatgaaatgagaagaaggaaaggggaaaaataaggaaaggtacatgaaatcaagaactgcaccagtaaagaaaaaacaaggagagagaagatcctggatattgctctttctccaatctaacattttcattcttggtaaaggtccggtgtcaagttcataaattgagcattatttttctgagaaatatctgggctctctcgattttttcaactatagcacatgcattgaaaagtaaatgaattttgaaaatttgctaacatgaaatcattatatcaatatttttatttcaacatttccctagttttctatgtacctgtattccatttttatgactaatcactttgtaaattaatgtgtaattgtttaagtatctacgcaatatagaataaaaagtgatacttcattgattttcttctgacaagttcctaatcactgttgggtttcatcacacttccactgtttctatacatttaaatacaaactcacagtaaacatacttttaaaaatcgtaaataggatcacactatatataaaatgctgtggttcaattgaataagagacagaagcttttgcaactcagaaagtttaacccaccttatacttttttgcaagtgtagtaagtaactcacaatacagagctaccataatgtattgactatctatattgaaagaatatttaaatttttttccacttttttaaccattgcatgcaatgtacagtgctgtaagtgtatttataagagtatttcttaagaaaaattcctggccaaatggaaattttgcattcagtaatatgtaaataacatatgtagacatttattaattatatttcagctatcagaatatcagagtatccatttcctgacattatcaacaaaactgaatattaatagtatgattctgaactccttttgcaatatgacaagtaagagatgatagaaagggccttttcacaaaaatgcaagttacgggaaaccagtccttaagcactgaagtggcaagaagagacagcagtcagaggaatctggagaaagttgctgtaacagtatggaaaacatttatatattttttcttttctaacataagcatttaagaatatatatttctctctatgcactgatttggctgcattctacaaatctcatattcaaacatttttgtttctttaggagaaggaggaggaggtgaaagtggaggagaaagaagcatttctctagcagtactgtgcttggttctgaagtggcagtgttttcatttctttcattccatttccacctcccacattttgcagatctgtgtgtgtgtgtgagagagagagagagagagaggagagagagaggagagagagagagagagagagagagagagagagagagagacttgtctcagattggctgggccaactctgtgtttcctgtagaaatgtttgaacatatgagagagcaaagcagagtgtttatcttgtgagccattctccatatttcagatataagatttcagttctcagtgagtctaagtgacagaaggaatggagaccctcttgggcctgcttatcctttggctgcagctgcaatgtgagttagagggaaatggaaatgagcaaagagcaggctgactccaggacgtttctcccaggaaagagggagaaagaaagggagttgttatgcctgtatggtttactgggaatttctgtggaaattgaaaaaataaatttaaaggtaatttctaaggaatcattagccactaaccagtctattgctctttttctgaacaggggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcacagtgcacaacaggcacctgcaaccaatacccaaactctatagctggggctctaactgcatgttttatcttgagactgagcaatgtttttgcattaagaggacttctaaattgacactgtctccacacagaagcaatcaaatacacaaaacttgatgtaataatctgaaattaaactatgaattctctgatctttagatttttatcaattttaatataaataatagttttatttcaattaatttacatgccatgaagttcagtcttttaaagtgaacaattaagtgttatttagtgtattcacaatgttgtgcagcttttatctctgtgtagtttcaaaaactttttaacatctcaaaaggaaaccacatgtccattaagcagttaccttgcccaccctcctcccagcctctggcagccaccaacctgttttcagtctctatggattttcctattctgtacatttcatataaatggaataatatagtaggtagtggcctttgtgtatggcttctctcacatggcataattttctgaggtttattcaatgtaggaaggaccagagaaagctaaatatgcacatctaaccaatgacatgcttatatcttccccatgcaagagcctccaaccagggcatacctgaagctttgttagttttcttccactctaaagcttccctactcctctgcctatctttaagtctctgccaaacacaagggacggtagctgattcctttggtataccaagctctgaataaattgcctttgcttttttcatttaggtggtcttcacttatatccacagaactattgtaaagacactgagtttttcttccctgccaagttctcacttcaccataagagtcactttgcacatgaaaaattaatgaatcaccataagaaatgttaaagctggagggcagcttgtcctccattcagataggtcattgaagcctacatcaatcagatagtacttcttagataagtcagagagatgcattgatgtaaagcccagttctcaatatttacgtgtcaaactctgtcctcaataaaagctcgaaactccaaacagatatcttggccttcctggaagattttcttatcaacaagtccttgttctcatttatttcttttactaaatattcaggctccatattgtgtgatgaggagtttgcattcacaacctctgccatatctgggctacaaagctgctttctttcttgacattacaaaccaactcgtgggtaagtaatacattcagatatatgagctataaaggagcttaaatagtgggggacttcaccaccccactgactatgttaggaagatcatcagggcagaaaactaacaaagaaattctggacttagggccgagcgtggtggctcaagcctgtaatctcagcactttgggaggccaaggcgggcggatcatgagatcaggagattgagaccatccttgcaaacatggtgaaaccctgtctctactaaaatacaaaaaaattagccaggcgtggtggtgtgtgcccgtagtcccagctacctgggaggctgaggcaggggaatcacttgaacttgggagacagagattgcagtgagcggagattgcagtgagccgagattgcgccactgcactccatcttggtgacagagttagactccatctcaaaaaaaaaaaagaaaaaaagaaattctgcacttaaacttgaccaattggatctgacagaattttatagaatacttcagtcatcaaccacagaatatatattcttctcattggccataaagcaagcctcaataaatttttttaaaaattgaaattataccaaccatactcttagacaacagtgaaataaaaatggaaatcaatactaaggagatctctcaaaatcacataattacatggaaattaaacaacttgctcatggatgattttagataaaccatgaaattaaagcagacatcaaaaaattatttaaaataaatgaaaacagagacacaacatacaaaaatctctgggatgcagcaaaatcagtgataagaggaaagtttatagtgctaaatgccaacgtcagaaaataagaacgatcttaaattaataatctaacatcatatgtagagaaacaagaaaaaggacaaactaactccaaagctagtaaaagaaaagaaataactaaaatcagagcagaactaaatcaagacacaaaaatccatacaaagcataaataaaaccaaaagttggttctttgaaaaaaaataataaacaagatgtatagactgctagctaaattaactttgaaaaaaataataaacaagatgtatagactgctagctaaattaacaaagaaaaaaagagaagttccagataagcacaatgaaaaatgacaaaggcagcattacaaatgataccacagaaataaaaagatcctcagaaactattataaacacttctatgcacataaactagaaaatctagagaaagtggttgaattcctggaagcacacaatcttccaagattcaatcaagaaaaaaattgaatcagtcattaagaatctagcaaccaaaaaaacctcctgggccagaaggattcacggccaaattgtaccacatggacaaagaagagcttgtaccaatcctgctgaaattattccaaaatattgaggaggacggacaccttcctaactcatgctataaagccagcctcaccctgaaacaaaaacatggtaaagacacaaagaaaaaagaaaactacaggccaatattcctcatgaatctagatgtgaaaattctcaacaaaatactagcaaaccgaaaccagtactacttcaaaaagttaattcaccagaatcaaataggtttcattcttgggatgcaagttttgttcaatatatgcaaatcaataatatgattcaccacataaacataattaaaaacaaaagccataagatcatctcaatagacatggaaaaaacttttgataaaatccaacatcccttcataataaaaacctttaacaaattaggcactgaagaaacatacctcaaattaataacagccatctatgacaaacccacaggcaacatcatattgaacaggtaaaaactgaaaacattcctcttgagaactggaacaggaaaacagtgaccctcttaccactcctagtcaacatagtattggaagtcctagccacagcattcaggcaagagaaaaaataaaagactttgaagtaagaaaaaaggaagtaaaagtatctctctttactgacaatatgattctatgcctagaaaatcctaaagactctgccaaaaactctgccagaagacccctggaactgatcaatctttcacttccttggttagatggattcctgggtatttaatttttttgtggctatggtaaatggtatgagagtgaaagatctctacaaggataactacaaaacactgctgaaagaaatcagagtcaacacaaataaatgaaaagccattccatgctcatgaattgaaagaatcaatattgttaaaatggcaatactgccaaaagcagtctagagattcaaaactatccctatcaaactcccatcattatttttcacatgattagacaaaactattctaaaattcatatggaaccaaaaaagagcccaaattaccaaagcaaaaagaacaaagacagaggcatcacattactcaacttcaaattacactataatgctacagtaaccaaaatgataatggtagcagtacaaaaacagacagatagaccaacggaacagactagagaactgagaaagaaagccatacacctacaatcatctaatcctccacaaagccaaggaaaacaagcaatggggaaaggattccctattcaataaataaacagaattaaaaacaaaagatttacagtaagacctcaaactatcaaaatttcagaataaaacctaggaaatacccttcttgatatcagtcttggcaaaggatttttggcttaagttcccaaaagcaattgcaacaaaaataaaaattgacaagagggatctaaataaggagcttttgcctagcagaagaaactatcaacagagtaaacagacaacctacagaatgtgagataatatttgcacactacacatccaacaaaggtcttatatccagaatctataaggaacttaaacaagtcaataagaacaacacaaataactgcattaaaatatggacaaaggacaagaacagacacttctcaaaagaagatacagccaagtggccgacaaatgtatgaaaacaattctcatcatcgctaatcatcagaggaatgcaaatcaaaaccacgatgagataccatctcacaccagtcagaatggctattattaaaaagtcaaaaaataacagatgctggctaggctatgggaaaaaaggaacacatactctgttgatggggatgtaaattagttcagccactgtgaacagtttgcagagcagtttggaaatttctcaaaaaacttaacttaaaatagatctaccactcaacccagcaatcccattactaggtatatatccaaagaaaaataaatcattataccaaaaagacacatgtactcgcatgttcattgcagtgctattcacaattgcaaggacatggaatcaacctaggtacctgtcaaatgtggattgaataaagaaaatatggcacatatacaccatggaatactatgcagcgacataaaagaatgagctcgtggcatttgcagcaacatggatgcacctagaggccaaatttctaagtgaattagtgcagaaacaggaaaaccaaataccacgttttctcacttgtaagtgggagctaagcattgggtacacaaggacacaaaactgggaacaatagatactggggtttcctgacaagggtaggactgaaaaactacctattggatactatgctcactacctgagtgacaggatcattcataccccatacctcagtgtcacgcaatatacccatgtaacagacttgcacataaaccctcaaacctaaaataaaagttgaaattgtaaaaaaattaaaaataaaattggatatagttatgaaaaagggggcttgactagtgctactttaatagctattatattccataatataaatgaacttctattgttaatgacaattaatgaactacattgcaagaataaatgtgagagttcacatttgaaagaagttgaaagaagttactttctcctgcacatggggtaacagcatcttaggtaggcaaacactttgctgttggcaatatggcagtgaacagttacaatttaacagggaagatgtatacacacaacaaagcaattcaaacaaatatataatttcaatgcatgataaggacaataaattttaaaaatggatatgaaagatgataaaattgtgtttactttggcacggtggggattatgctgctggtggtcagagaaggcctctctgagaaaatagttacattgagatatgtaggaaagattgcaatagcaaagttaaggttcctgctaaaaagagctgcaggcagagagaaccacttgtacgatacagtgaacttaatcaataaatcttttgtgtgtgttctgacttctccaccaagtgaccgtttgcccctctctttctctctctgcaggcctttctatcccctaagacataacaatattgaaaattggctaacagtgacttctaactgttcaagggaaaggaagagtcgcatatttctcacattatttatttttctttttgtggagatggggtctcactatgttgcccaggctggtctcaaactcctgggctcaagcaattctcctgcctttgcctcccaaacagctgggattataggtatgaaccaccacgatgggactctcattttaagtcaaaagctagaaatgattaagcttagtgagaaaagcatgtcaaaagcccaatcaataagctgacagatagacctcttgaactaaacagccaagttgtgaatgcaaaggaaaatttattgaagaaaattaaaagtgctactccagttaaacacataaatgataagaaagtaaaacagccttactgctgatatggcaaaagttttagtgttctggataaaatatcaaaccagttacaatattcccttaagccaaagcctaacgcacagcaaggccctaactctcttcaattctgtgaagcctgatagaggtgaggaagctgccaaaggaaagtttgaagctacaagaggttgtttcctgaggtttaagaaatgaagtcatcatcatgacataaaagtgcaaggcgaagcaggaagtgctgatgtagaagctgcagcgagtttccagaagatctaactaagaccactgatgaaggtggctacactaaacaacagattttcattgtagacaaaacagctttctattggaagaagatgccacgtaggactttcatagctagagagaggaagtcaatgcctgacttcaaaacttcaaaggacaggctgattctcttgttaggtgctaatgcagctgatgactttaagttaaagccaatgctcatttaccattctgaaaattctagggcccttaagaattatgctaagtgtactctgcctgtgctctataaatggaacaacaaaacctggatgacagcacatctgtttatagcatgttttactgaatattttaagcccaatgttgagatctactgctcaggaaaaaaaaggttcctttcaaaatagtactgctgattaacaatgcacttggtcacccaagagttctgatggagatgtacaaggggattaatgttttcttgcctgtgaatgtaacatccattctgcagcccatggatcaaggaataattttggctttcaagtcttactatttaagaaatacattttacaaggccataactgccatagatagtaattcctctgatggtctcagcaaagtaaattgaaaatcttctacatgataccattaagaacatttgtaactcatggaagtaggtcaaaatatcaagattaacaagattttggaagaaagtgattccaacactcgatgactttgaaaggttcaagacttcagtggagtaagtaactgcaggagtaaatactttagtggaataagtaactgagataattttgaaatgatattgatggttcttgtatattttaactatctaggacactgctgtagaaagcttttaagaatgggagggaaatcatgggtttggcatggttaagttgttttctttcctggaggcagtaaacgagttgaaaggctcttgaggtgccctctggagctcagaatttttaaatgccagttttaaaagatccaaatgattatcaaaatatagtggtagatagcaggagaactagaattagaagtggaacctgaagatgtgattgaattgcttcaatctcatgataaaactaacaaataaggagtttctttttatgggtgagcaaacaaagtagtttcttgagatggaatctattcctggtgaagatgctgtgaacatcgttaagataacaacaaaggatttagaatattttataaacttagttgataaacccatagcagggttttagaggcttgacacagattttgaaagaagttctactatgggtaaaatgccatcaaacagtattgcaggttacagagaaatctttcatgaaaggaagtattaattgacgcagcaaactgcattgttgtcttattttaagaaattgctatagtcaccccaaccttcagcaatcacatcctgatcagtcagcatccatcaacatcaaggcaagaccctccaccaacaaaaagattatgacttgctgaagaatcagatgatcgttagcattttttagtaataaagtacattttaattaatgtatgtacattgtttttcacagtgctattattgtccacttaatagactacggtgtagtgtaaacatagtttttataagcactgagaaaccaaaaagtttgcatgactcaccttattatggtggtctataatcagcaatatttcagaggtatgactgtatttgactttgccatcaactcaatgacttacactccagaaattgttattagcagaagcataccaaaggtcaggcaatgggagtggtttgtcccagttgcaggtaataacagggtgctttatagagagctttttaaaaacaatataaaaatgattaatagccaatctgatttttattaccgtatgccaggaattctaaacaatgtcaatgataaaaaatattttttgacctaagttctaaacaaatgcagaggttactatttattttaataataaatgtatgcttcaaattatcacatttttatttcttatcatgtaataaacagttttctacatggaagttattttggagaattctcagttttgcagctgtcttcaacacacatggattgtaatacagcgattttccatgtaccttttatccagtttcctctaataatatattatctttgatatgttgtatatatatcaaaacaatgatataattacagccagaatatggatgtcgatatagtcaagatacagaacatttccatctctacaagcatcctcatgtttcccttttattagcaatagcaacttccattatgccaccatctactatttaacccctggcaaccactaatttgttctccatttccataattttatcaagaatgctatataaatggaatcattcaggatatttatgaacatgaatatttttcactctgcataattatctggagattcatacaggtcgttgtatatattaatgtttcattccttttcattgctgagtagaatttcatagcatggatatgccagtttgtgtaaacattcacttaatgaaggacatttgggttgtttccagttttgagctattatgattaaagcttctataagtgttcatgttcaggtttttgtatgaaggtgagtcttcgtactctggaatatataccaagtagtacaattactgagacatggagtaagtgtatgtttagttttataagaaatcgccaaagtattttctaggttgctgtactgtcttgcattcccaccagcagtgtttgagtaatctaatttctccacatttctgctagcattttgtgttgtcattggttaatacttcagcaactctaagaggtatggagaaatcattgtagttttactttgcatatttctaatagccagtgatgttaaacatttttggtttttctttcttttttaaattaactaaagcccacactttattcctatttcctttgtttttgccaaatgtcctttttatgtctgcagggtctgtaataacactccctgtttcattcctaatattagtaatttgccttttttttctttgttttactacaagtttgtcagttttacccatctttttaaaaacggctgtttaatttttgtttctgttttcagttctattgatttctgcttttatcttgattaattccttccttaaatttgctttggattaattttttccttctttttcttggttcttgaggtgggaacttagatttttgtttggatacttttttcatttttaatatttgcatttagggatatacattttctctcaatgctgctttgactatgtcctacaaattttggcatgttgtattttcatttccactcggttcagtgtatgattgatttcccttgagcttctttgatccttggattattaggatgtatgttgtttaattttcaaatatttggagatttttctgctctctttctgatatttacttatagttgtattctattgtggttataaaacatagtctttattgtttcaattcttttacatttaattttttgaggtttgtcttgtggcctaagatatggcatacttggtatacgttctacaggcatttgaaaagattgtttattctgccattggtaggtgccatgttctagaaatggctattagatcctgttggctagcagagttgttgagttcgtctatgtccttgctaattttctggcaagctcttctattagttattgagagtggggtgttgaagtttccaactataattctagaatcatcggtttcttctttcattactatgagtttttcttccatgtatttttcagctcttttggttggtgtatacacatttagcattgctattccttcttgaaagactgaccctttcaacaatatataatgttcctttctgtctcttctgtctctggtactttgctttgctcagaagtctactttacctgatatcgatataattattttgactttcctttgattaatgtttgcacgatatatattttactttctttctttctttcttttttttttttttttttgagacggagtcttgctcagtcgcccaggctggagtgcagtggcgcaatcttggctcactgcaggctccgcctcccgggttcacgccattttcctgcctcagcctcccaagtagctgggactacaggcgtccgcgaccacgcccggctaattttttgtatttttagtagagacggggtttcaccgtgttagctaggatggtctcaatctcctaacctcatgatccaccagccttggcctcccaaagtgatgggattacaggcgtgagccaccgcacctggcctatattttactttcaacatgcctatgtcattaagttagaaatgaggtcttcgtagacagctgtagttggatcatatttccactcttttcactttctctgtattttaactctcttttcattgctgtttgtagaccaatctctgtatcttaattggtatatgtacatcatttgcatttaatgtaatgtatattttagtgattaatcttccatttaattttgtttgttctgttttttgtttccctgtgttttatctcctaacttcttgtgaattatttgacattttctaaaattccattcaatttacctataatgccttggatgtgtatttttgtgtagctttcttcagtgtttgctctaatggctattataaatagataacacagttgtctattggtgatgtcattccaccaatttaaatgaagtataaaaacattgtctccctttacattcagttgtcctcaccaattcatgatacagttttctttatgttttccccaatatatatttagaacctcatcagacagtgttattatttttgcttgatccatcaaccataactgtgaattaaaaaaattgatcaaacatgtttggagtaaagacttcattatcttattttctctatataggaaatattacaaatttattgtcatatgaagtcaattaagaagtatggaaccaaaaaatataaaaacaaaaaatcttaattctggcaaggacgtggagaaaagggaactcttgtacactgttagtaggagtgtaaattagtataaccactatggagaacagtatggagtttcctcaaaaaactaaaacctgagctaccataagatccagcaattccactgctgggtatatatccagaagaaaggaaatcagtatattgaagaggtatccgcactcctgtttgttgcagcactgtttacaacagctaagatttggaagcaatctaagtgtccatcaatacatgaatgaataaataaaatgtggtacatatacacaatggagtattattcagccataaaaaacaatgagatcctgtcatttgcaagaacatagacagaattggagctcattatgttaagtgacataagccaggcacagaaagacaaacattgcatgttctcatttatttgtgggatctgaaaatcaaaacaattgaactcatggacatagagagtagaaggatggttaccagaggctgggaagagtagtgagggaatgaggggggaggtggggatggttaatgagtacaaaaatatagaaagaatgagtaagacctactatttgatagcacaacagggtgactatagtcaaaagtaatttaattgtgaattttgaaataatgtacagttaaactaagagtgtaattggattgtttgtaacacaaaggacaagtgcttaaggagatgaataccccattctccatgatgtgattatttcacattgcatgcctgtatcaaaacgactcgtgtacccctaaaatatatacaactactatgtacccacaaaaattgaaaatttaaaaataaagtattatagaagtgtgtcagataaacaaggaaatatgtaaatttctgaattctgtatttatggtattcgtgttttaaaatttatagtttgttgtgattttctgacctaaaattatttttgtacccagttttattcttatttttatgttattctttttaaaatcctccatcttgtaagtttcaggcttacaaacataaatcctcctttgtacattatcataaatctttgaaattcaacactagaagggcaggaaggatgtggaggaagttcacaaaaattgtgaatttctcttagccctctatttggcccctggagggtgttgttgcctaaattggaaatggcttttctttaaaagattagaataagctccttccttctctacaggttaaagaggtgtcctttctgactgagcattcttttagacagcgatgtataaagaatctcagacaccagaggcaggcaagtttgtcaagagagcatctcttactagcagtttctacaagatccctaagaagaagaaatctaaatccctgccatttctccttagtttcaacctggattcaagttaccccgtggtcagattgtgtctgtggggaatctcctggaaaggtgcatgctgctccctcagtgcttggctagatctcattgtgtgtcttgacgcttggggtactcctgttcccaagtgggtatcattccattttactctcttgtccacaaatggagcattgtctatttgactctgaatacggactttttgtgttagctgagttcactgacatagcattggcattgtaggaaaaaccactgcccattctgtgactcagcctgacgttcatgtcgctgtctctgaaggagcccctctggagctgaggtgtaactattattgatcttctgttccaacatatattttctgatatgtgcaatacctcagccaaggactccagcttctcctgaagtacctatcaggatatagggttctttcaggaattaacggttttgaggctgaatttaagaagaatgaaaactgcttcctcctgaggaaaccctcagcctattggaacgacacgctgagtacttctgtgctgagtcccgcattgcccaggactgtagtgggggctacataaaaactacctgagacacatagcttaaacaactaaggatctcagcctcagttattttcaggaagttgacgtgttctgtgaaagcaaacagtacaaagaaagtagaatcctgtctagcatttagttcctatggacatcttagatttctttaatttattttcttatttgccattttgcaaaggaaagagcttgtacctgattctagaagaaattagactataggatttgtaacaagcaggaggaggtgatttgcaccaaggtatttcagatagtgatggactgggatgacttaaggttggccatgtggattggtataaggcaaatcaatttgcttttagttattaatctcatctctcaaacaatcagaaacccagaatgagtgtttatttcaagctgcattatctacagattattttacccagtatcctgacttcagtgagctacagtcctttgaggaaagaagcctcttcaaaggacttcagctcactgatgaaagtatttgagactgggagacttaattaaagctgacatttaaggatgtgtgcaaggcaatctttccaaagacaatataaaagggaaaaaaaaggctttatttttttaatctggtggtccccagcgaaaggcagtctaaattaaacacaacatcatggcagagttccatgtggaatcttggggttggttgttctatggatgacctaccctttatcagttctacccagattacctctctctgtttttctccctttcaattcaatttccctaatacttgctgagtgtccaataactattgttgattccttaaccatatttaattatttctctacaccattcctcatagtgccaatagtaactatttgcaacgttcttgagcagttaatccaatgttgtgcctgcagaacttttatttctacttcagtaaaaatataggtgttcttatttttcaccccctttacctccaaatccatttccagattattattatttatggagtctggggcaaaagcaaaaacaaattattttcataacttttaaaaacagctaattttcttttaaaccattagaataatctagtaaacctaaaaagcaaaatataaataataattaacaatgaatagctttaataaaatatatttaaataaaattagaatttatttgtttttaagtttaattcgatcacagtatttaaaataaatgctagtttcaacattcatctagtatataaagaagctaatcagtgtcactctttatgcagattcaatctaggataaaatatatgcaatttaaaactaatgttgttgaatattacaaagtgttccagccatcatgagcaactatagtgaatactatgctgattcatgagtaccctgaagaaccacaaatgagtacataagagatgcaagaaaatagatcctcagcaccctcgggaaacagtatttctttttgtaagaatctattgcctccgtgctgagaggaaagatggggctagctaattaattttttccttcccttccttgaaacccctccacccttggccccaattccaaatcagagtcatatgaagtcaattaagaagtatggaaccaaaaaatataaaaacaaaaagtgttaatgctggcaaggacatggacaaaagggaacccttgtacactgttggtaggagtgtaaattagtatagccactatgaagaacagtatggaggttcttccaaaacctaaaacctgagctactataagatcatatttacttatttttctacaccattcctcacagtgccaatagtaactatttggaacgttcttgagcagttaatccaatgttgtgcctgcagaactttaatttctacttcagtgaaaatataggtgttctcatttttcatcccctttacctccaaatccatctacagataattattattattgatggagtctgggggaaaagcataaacaaattattttcgtataaacagagtctgcctcctatggcagcagtggcacaacccacaaatatttctaatatttgaaaaggacaaaggtcaaggtatgtgaagaagtatttttctcaaatctgaaaaattgtgttagtggttttttaggttacagattgtgcccggtcctgagtgacagagacagtccgtgttcttcagtacatttgcgtgtgtgtgtgtgtctgtgtgattgagtggccctgtaaaatatgaggctctgggcagggctcttgcctgagtctaagggtcatactgtccacaaccttgctcatcttctgtccttcttgtatttaaaacaaagggtcacttttcaaagtttgccatctttgcttttgttactctccagtctcgtcacctccacagaaggcatgtagcatcacatcccccatcaagtcacatcctgtaatagaagtttgacataattgttactgtcttggtgctcatgtggtgtttaaggatgctttttaaaaatgatatcctgtaaacctttattacattcagagagatgtttgtctcctcactatatcacaagctctctgaaggaaaaaccgtatccaattcatttttttttttaatttccaaggtctcaaacactcttaaatatattgacttaactataactgaatcaaattggtgagctcatattttttcagttcatacgtatgaattaaatggatgttctaattacataaaattacatttaaagtatttatcttcataaaagccaccgtggggtctcatggccctatttatggtactctccattctgtggacacttctgttgtttcatgtcaacccacaggtacagccctaggaaaagacagctgggctgagctgtccatatatgctgaggaagatgtagtctttctcaaggtttagcacgtcaggaggcatataggcttctcttaaattgagggacggctctgaaggatctagtagtgaatagttgttgaaagatttgagaaatatattgagtataaggatgagggccagtaagagtaaagagggaagaataattatgtgcaaggacaaactaaatcattatcagcacataagaaacatatttttgctgagtattcttttcaattgtagctctgtcctctaaaacaagataaatgacatatgaatattcaagttctaggttatatttgaaatgcatatatatatacctatatttaaatttttgtctttatattattatctttatctgtatctatcagaaaatcctggatcaaacagaatcatatacagcaaaagggaaagtggagaattccaaagaagggaattcggattttaaaaaatttttatttcctaagatttcctaagaaaaaaatatgaacttttatttcacaggtccaaaattatttctaaactgttgaaagccatcttttctttagtattcttctgtccctttcatgtaactagaaccccctaccctcaaccaaaaataaataaataaatagataaataaataagtaaataaataaaagagagagagagaaaaggaagaacatggaaacagaaggtaatgataggagaaagtggaaggaaaaaaggaagacagaaaaaaaaagaaaaaagatttactggactgtaagataagctataaaggaagtttgtataaaataagaattagaaaaataaaacatattgcccatccagggtaatacgtagaaaaaaatttgaattgatcttattttttctctcacaatttacagtcttactagggtcatttcttataacaatatttaccacaattcttgattatttcagaggagtcctaatccacacttttcatatattctaataataaaaattattacatatataatacataacatgtatgttcttattactttacatgactggaatgactttcacctaaattggctaataaagaccttcttgtcagaacacattcttgttttgggggtttaaaatgtggacactcattctgtgatcctctccaggctcgaattagtattacagttgaggcacgttgtcctcccgaggaggcccctccctttccttctcacaggatctttcacattctttactatatccagaattattagaaaacatccctcaggttacggaataatgacctttctttttcccttccactccacccctttccaccccggctctcagccaggtttaagtcggcgggtggggcttcctgtcacagaacgctgtttaaaaactcagtagcatctgggcgtgagcaggctttgtcgggtggagctgattggttgcaggagcagcaacagttccagagccaagtcatgacaccgacctccccaaggtttagttaaatatatcttatggtgaaaatgcccggagcaagaaggcaaagcatcatgaagaggatattgggagctctgctggggctcttgagtgcccaggtttgctgtgagttggggctgtccaaggtgggaatctgaaaggatttagcagctgcagccttgttgaggggaggaagggcaaggagttaaaaagtcatgcagtctttctattcacacaacctgtgggggcattttcaggattcttcagatgttaaactgcccatcacctatgactttttctccatttctgaccaggtgtgagaggaatacaagtggagcagagtcctccagacctgattctccaggagggagccaattccacgctgcggtgcaatttttctgactctgtgaacaatttgcagtggtttcatcaaaacccttggggacagctcatcaacctgttttacattccctcagggacaaaacagaatggaagattaagcgccacgactgtcgctacggaacgctacagcttattgtacatttcctcttcccagaccacagactcaggcgtttatttctgtgctgtggagccacagtgctccccaggcacctgcggcctgtacacaaaccctcatccgggctcggttcctctaccagtaacaaccacatcacgaggccaccgcagcagcattttgcacagcttaatattccttttgtacataggtagagttttaaccgtagattctttttggctctacaggtttgagactttggtctttattttcccttttcaatacacacctcctcctaccctataaatatctaacttggaaggagtagagtagctgataagaggacagaatcaaaataaatatttaagtgacagtatgcaggactccaaaagggtaaaaagtaaaaagaataaaaagaaaagaaacaccattccaataagcatgttgttagacattagttagacagtgatccagcttagttgtgtgtctcaagcacattcaggtctacctcaccacattatgtaccaacagacaagggcaaatatttgcatactatcccactagtgcagcaaagtaaaatttctttaaatattcacatattgataaatagctgtggagaaaaaactttaaaatgttatgttcccatatgtgtttttcaggcttgttgtataacctagaatatgatctatcctggaaaatataaccatgcatgattgagaagaatgtgtaatctgatcttgggtagatagatgtctgttaggtctacctggcttttgtgttgttcaagtcttctatttccttgttggtattctatttgtcctatctattattgaaagtgaggtattgagtcttcacctgttattcttgaattttctgtttttcccttcaattctgtcagtttttgtgcatcatgtattttgggatatgtcattaggtgcatatatgtttataactgatatattcttaatggatgcccttttatcattataaaatttccctttttatctctagtaacattttttggtttaaagtatactttgtctaataataatgtagtgactccagtcatatcttttcctatccttttactttcaacttatttgtatctttgtatctaaagtgtgtctctgacagtgtatagttgtgtgtgtgtgtgtgtgtgtgtgtgtgtgtagccattctgataatctctactttttgattggattgtttaatccattaacatttaatgttatcattgatatagattatatctggcattttaattttattttctttctgtcttatgtcttttttgttcctctgtacctccttaactgctttcctttgcattaggtgaatattttatagtataatattttcattcctttatttttttcactatgctttttcaattattttcttggtggatgttttagtacttacaatatatatacatctaaacttgtcagaattcacttcagactttatgctaacttaactccaatgggattttcagatgtcacttctatataggtctatttcttattccctttattattgttattcacattatatgtatatatgttacaaacaataggttattataatttttatataattttataattatttctttatataatcttatgttttataagctgagaaggaaaaaaggaaagcaaatatatattgaagtgtttgttgttaaccttcttacttatcatttctgggtctcttcatttgttcctgtgcacttaatcatagccaaaaggtcaagaagtgatcatttgttcctgtggattcaagttgccatctggtgtcactgtcttactccaatatagttttgcaatctgccttcctcctttattcttttattatcaaatatgttacattcctgtaagtccaataatataattatatatgtattgttttatacagtagttatttaaatcagttaatagtagaaaggggataaatatgcagtcacactatctttttagtaagtgtgtggatgcaaattactgtttgaagtcccttgctcccagcctgaagatcttcctttattattgcttgaaggtgagtctgcttgcaataaattctctcagtttgtatttatctaggaatgtctttattttaccttcatgtctgaaagatacttttgctgaatataggatcttcattgatggtatatttctttcagcactttgaatatatcttcccactgccttctagctctgttgtttttgttgagaagtcagctgttaattttattgagtttctctcataaatatttgattttctctttctactttgaagattctatttgtcttttaacatttttgctatgatgtgtctgagtgtggatctctttgcattcattttacttagagttcactgagcttcttagatgagtagattaatgcttttttgaatctgggaattctcagccattgtttcttcaaatttttttgttcctttttcttcctttcctttttctggtactctcactatgcgtatattggtgtgcttaatgatgtaccacgtttctctgagtccctgtttatttttctttattcttttttctgtctgtttttcagattgcataatctctgtagatgtatctttaagttcactgattccttgttcagggagcccgaacctactgtttgaccctccagtcaatttttttatttggttattgcactttcccaactctagaatttctattttgttcctttcataaaaaaataatttttaccactttatagatattctctggctgataagaagtcatcatcatatcttttttacttccctcagcatggttttatttctttgagcatacttaaaacagctattttgaaatttttgtctgtgaaatccaacatctaagtcatagaaaaggaagttgccattacccaatttatttctcttgtgtaagaatcacactttcctgtttggggtatatcttataattttttgttttaaactagacattttagataacatattatattagttttctatggctgctcttatgggttgaattgtgtttctcaaaattcaagatgaaatcctaactcccagtacctcagaatgtgaccttatttgaaaatagggtcattgcagatgtaattagttaagataaagtcataagaatggaccctaattgtgatggttaatgttaggtgttatgttgattggactgaaggatgcctggataactggtagagcattgtttctgggtgtgtctgtgatggtgttgccagaggagattgacatttcagtcagtgaactgggagaggaagacccacactctttgtgggtgggcaccatccaataggctgcgcagctacaacaaagcaggtgaaagaaggtgggaggcttctggctgcctactttctcccatactggaggcttccttctgcttctcttgtccttgcgttcctggaccaaactgaggtttgggctgctatttttttacagacaaataacgagatgcagatgaactggggaggaagagagtttttatttctgtagtcagttacagggacatggcccggaaattattgccagactaactcaaaattacaaagttttttcagagttttatataccttctaagttatatgtctacatgtaagtgtgcattcatttaaagacataaatgattaacttcttttaatttataactaaggtctgagtcctgaagaccttcttctagagtctcagtaagtttatttaacctaaatgggtttaggtgctggggtgattagccttatctggtcttctgccaaatcacagaggtttggggagttccttcagacctccaataaatgtgtttgtggaggcctagcgagtttcttcagaccccctataaaacttgtttaatcctaaagaggccctgttaagaattactcctttattttgtcatgcttaaaagcccaggaaagtcccaggcaaaactcttggtgggcttttgctacattccagcctttgtataagggcactggcttttaatatttatcttaaccactcagtcagtaccgaaacagttgttatggagtcctgccacacttggacatcagactccaggttctttggcctgtggactctgggacttgcaccagtggcttgcaggtggctctcatgcccttggccgtagacagaatgcttcactgctggcttctttggtttgaggctttcgagcttggactgaaccactaccagcttctcttttccccagcttgcagatggcctatcatgggacttggccttgtaactgtgtgagccaattctccataataaataaataaataaataaagtttattagggagaattggcacacacaattacaaggccaggttttatatatatatatgtgtgtgtgtgtgtgtgtgtgtgtgtgtgtatgtacatacatgtatacacacacatacacacacacacacacatacacatatatcctattagttctggagaaccctgaccaatacactaatctaatatgactggtgtcctcataaaaagtgaaagtttggaaacacacacacacagagggagaataccatttaaagatgaaggcagagatcagggtggtactccaacaagccaaagaatgctaaagattgccagaaaaccacgagaagctgggcaagaggaatggagtagattctcgtagccctcacagggagtctctcagacttccattctccagaaatgtgaaacagtaagttcctattgtttaagtcacctagcttgtggtactttgttatagctctagcaaactaataaagctgctataacaaattactgcaaatttggtagcttaaaaccaaacaaatttattctgttacagttctggaagcaagaatctgaaaccagttttacagggctacagtcaaagtgttggcagggctgatttcttctggaggctctcagggagaatctgcttcctggccttttccagcttctgctgtccacctgaattcatggctcatgctcttttttgaatcactctaaacttttgcttccatcatcacatctcctttctcttctggagccacatcttcccctgtttccctcttataagagcacttgtgattatatttagggtccactcaaataatccaaaatatttttcccatctcaagatccttaataatgtattcaaagacatttttgccatataaggtaccatttgcaggtaccaggcattagggcttggttatctttggggatgataatccaggctatcacatatagtgactctggatattgtgtctctaccccatccagggcttgttgttatttgcttgtttatttattgtaacaactttacttgactatttcagttaagtccattttcctgcagggtgcagcctatgatgttattcctcagaggacagtctttggtatgtgcacagacatcttgatatgacggtggtttcagcagtgttttctttaactgtctttcttcctgatttttctgttaaactacctgcatctgtttgtatcacacttagccatgagcctccacacttatccatagtctggttcaattaaattcaggcccctttgcagaggtaatctttgaggtcaatctttgaagcttcttataacctcaggaggactcttcccagctgtctttattcccggttctctctattagatttttagctagtcatctgtggtttagtttgttgctctcgtggagctaccagcctcctcttaattgcttaccacaaaaatcttcattcatttccactgtacccttaaggcttggacttcctgaagctctgttccaaatagagtcttcctagtggagagctctctgttcttataactcctcctctccctgggcacaacttctgtgcccctgctctggagcaatgtgagaagagacattgcttttctttcctcagagtgataaccctactttaggagcaaggtgcttgatgggggcagtatcccatggtcttcttgtttgcctcccccggtatgaaacctccaccttatgagcaagctggggtgagggaaataaggacccagtattcttggtctgccatgccagggtagagcttctgccctaacagtaggtgctaggaagtgaaaaggagccctaggcctttcagcttccctggcccagaataggacttctgcaatacaaaattgaggaagatgagaattgttggcagactgtccctcccaggcagatatcgtagctcaacactggaatctgagggaagaaggagccctgtattcttggttgctcccacccgaagtagagtttctattatgctgagctctgtgtggtgggggaagtagtagtcatggctcaaattccaaggattttgttcttatggtgatttagtaaattttcctgaatagataattctccatttgctatatacccaggacaatttccagagacttaagtttttaaaataatttttaccaattaatagtgttttgttactaattagggagagtaaccatgaacctcctcatattgcaattctgaaagtcacagcctcccattcatgatgttatcacatagaacaggcctaaacagaagataatcagaagttcaacttttctttgactttctccattgagaaataaaggtgaagctgccatcttgttttgatcctaaacctgccacagagataattattcaaacacgtcatgtatcaccatcataaaataagcatgtattctgagagtattaaagatgaaaaacaggaacactatattttcttaaatcatagtttttgtaggaaggatggagtgaggtagaataaacaagtctaggattgcctagtttgaataatttcggtgggctctgaggccaggactatccctagttgcctggtacctggccatgggatgcttagggcagggggaatagtggatggagtgtaggagcctagtgacagcctgataaaggaggtgcttggagtatgggctctatatcggttggtttgcatttgaaagatgtgctcccaagtgagtctttactatctctaggaattagccagagatggttaaggcccttagatgtcaaaacatttgggtaaaaagatgtggttgatacaccaacactgttggaatatgagacttctctatgcctcactttcctttggatactcttgttcattcatattttttctttacttaaagttaggtactctgactttgcctattatgttccttttatgattaataataacttgcctaagtctagtctttactagagacaacaatcatcaacttaattcactcaactctccaaagctaatgttattacagccaatttgaaaagtgataaaagggtatggtacactaacactaccaatagtgatagtctttgtaggcaatccataggtgaaaaaagtccttacattacaaaaagtataacatatgatggtcattatttgtcaagaatgaattccatttgagttccattcaaaatggaattttcatttcatacctacagctactgggaactgttttctgtttgggaatcagtctcttcatggccaaaacagagccaaggccaatccttctgtaggtctattcattaggctattttaagggcatgacccccaacaatcctcagtggagcacattattttacaaaaatcataaagcaacgaaaatctttctgaagaaaaactcctgagggtagtgacaccatccatatcattaaacaatttgcagtggttatcaaaaagtattttctcacattagctaatacaataaatatagtagtatatccaaaatcttggaatcacagcaagccagttaaaatttcttaatccaaaggcctatgtgtagtagaatagtcacatatttttgtggggccaatcaggaagtgatctttgtcattgctaatacttcatgttgactctacgttaatactgaagatgagtaaaaacacttttagcatagatagatgatagatagatagataggtagatagatagatagatagacagacagataggtagatagatacatagatgagacatagataaaaagcaacctagttgtgtaagatagactcagaaaatcatttggactttttttttttaatcaagtctgggaaatcttggatcatggttgcaaaatatcttaccctttttataatatttaatacttcagatttgttcatttgttgcatggctctgttggtattctaaatatcactgtccccacaaatggttgaacaagtaatccaaagacaaaaattcaataaaagtcatgcttttaaatatacaaactaaaaatcaaatctctacaggccaaaactctttgtcaagaaaatcgacaatagtggagaagacctggacagttcttgaacatcttttctgcagctttggctgcataaggaccaaaaggggatggggggtggggagaggggaggaaaataaaattattcccatagatttaggaaaagatagattgttacacagccataataagtagccaccagaaccagttttatacctgttcaactgattaacaactcgtctcaatgaacatgcttttgcaagccaactaatcaatgtcagctcctggcttctgaaagtcagccagtcagtgcccctgagtgccaagcaatcagcaatagcctcaccctagtgactctgtttctgcagataatgttaactcatttacacctctgaagtttgccaatccctgaattccatgcttccccaaaacccagtataaatcagctgtctgttgtgctcagcaagattgtgtctgattttcataggtctcctttgctattatttccaataaatgcacatggtctttgtatttcacacattgagtagtgtcaaatccttcgacagctgccaaagtatattttcttgtgggacatttggacttggacaacttttcttactatttttcttcaatgctcaaaacaaacctaacataaaggatatttattcttgtttgaaatgatattcagcatcagcagaaatagttaacatgctatcagaacttataaaatcaacatttagtattataagaaaatgaatctctctgcagatcattccagccagaatagtgatgtttattgctttgtacatcattgaagtcactgattccaaaatcagctatttcaaagcagttgtggattacatttagggtgattgtgtcccacatagcatagcaacaagattcttcactgctatcaaaaatattccattaaaaaatctatactagaaatatttcttcttattttacataatatactaagtgcataaaacttttaggtaattaattatgccttcatctaaaaaccgcatatatattatggtactagaggacaaaaaaagatattgcaaatactgaaataagtccccagttcctttgggcagcacgtttatcaaaacagattttatctattttggcaagctattctcctctctaattgtaggaaccatctcccaaacaatcttccaacatcagtggatttaactttaaatatacatataggagatatgtgtatatataggggattttcaaatttttctacaaatggtcttacttattagtctcagcattgtagcacagtcagacttcctcttaatgaatgtatatatgtacatatgtatgcataatatatgtctgtgtatatatttttccttgagaaaaatgcttttcaccaagaactaacatctggcttggctgaagattatagaagagccccatcttataattattaattatgcccatatgcacatgcttatcctgaatagatctgctgatttcaagccaaatattagtagccaaaagagtttctgcagatgctgtatattttagagtaatggcataatgttctgacaatgccagcaattgacctatatctccattcaaaatgtaattgtattaatcttttatttagaaaaatgattcagatctaatttttttcactctagattagtaaagcaatctaagaatttcgttttataaattaaccttttgtttcccctctcattctttttaccttccttggcaggctgtttttctattctgttctggtttttaagatacatacatacacacacacacacacacacacacacacacacacacacacagatgtaccttggagataatgtaggtagggttccagatcaccatagtaaagtgaatatcacaataaagtaaggcatatattttttttagtttcctggcacacataaaggtttaaagtatactgcagtctgttaaatatgcaatagcattatgtataaaagtgtacatacctcgacttaaaaatgctttattgctaacaaatgctaattatcatctcaggcttcagaaagttgttacttgttttgcaaatgtagggtcttgcctcaatgttggtggctgatcagggtggtggttgctaaaagttgaaatgtctgtggcaatttcttacaataagataaaaatgaagtttgccacatcaattgactcttactttcatgaaaggtttccctgtagcatgcaacactgtttgatagcattttactcaaagtagaacttttttcaaaattggagtcaggataaaaagaaggaggttaatggttacagaaatacagttagaagaaacaaattctactatttgatagtacagtagggaaattatggttaacaataatttactgtatatttcaaaataactagaagaagagaattgtaatgttccccaaaacaaagaaaagaaaaatgtttcaaatagtggatatcccaataaccctgatttgatcattgtacattgtatacatgtatcaaaatatcacaaatgccccaaaatacatacaactataataaattgatttcaaaatctttattttttttttttgagacggagtttcgttcttgttgcccaggctggagggcaatggtacaatttcggctcacagcagcctccgcctcctgggttcagccgcctgggttcaagcgattctcctgcctcaggctcccgagtagctgagtttacaggcatgtgccaccacgcccagctaattttgtatttttagtagagacggggtttctccatgttggtcaggctgatctggaactccagacctcaggtgatccgcccacctcagcctcccaaagtgctaggattacaggcgtgagccactgcgcccagcctaatttcaaaatctttttaaaactactaagaaaatttttaaaaaaatggaagttaatcatctcaaatcctgccactgctttatcaactaagtttatgtaataatctaaatcctttgttgtcatttcaataatgtttacagcatcttcaccagaagtagattccatcttaagaaagcaatttctgtgcttatccataaaaagcaatttatcatttgttaaagttttatcatgagattgtagcaattcagtcacatcttcaggctccacttctaattctagttctcctactatttttaacacatctgcagttactttctccactaaagtcttgaacttcttgaagtcatacatttggattggaatcatcttcttccaaattctgacaacattgatattttgacctcctcttatgaatcatgaatattcttaatgtcatctagagtatgaatcctttccagaagcttttcaatttactttgcccagatccattaaaatacaagcacgttttattttattgcatctatttcttgaaaacttttttaacccattgaattgtcttgaaaattaattgaatatgaatttgtgaatctatttctattttgtttctttgatctacaaattttattttcacaaataccaaactgttttgattactgttctttataatgtcttgagatcaggcagggtgagtccttcaattgtgttccctttaaaaattgttttagtggccgggcgcggtggctcacgcctgtaatcccagcactttgtaaggccgaggcgggcggatcacgaggtcaggagatcgagaccatcctggctaacgcggtgaaaccccgtctctactaaaaaatacaaaaaattagccgggcgtggtggcgggcgcctgtagtcccagctactcgggaggctgaggcaggagaatggcgtgaacccaggaggcggagcttgcagtgagccgagatcgcgccactgcactccagcctgggcgacagagcgagactaggtctcgaaaaaaaaaaaattgttttagttattcattaaggtttattttttgcatttccatataaattttagaattagttggtctatttctataaaaaggcctgctaaaattttgagtgatattgcattgcacttacagaaaattgggggtagaactgccatctggaagctattaaatcctctaattcatgaacatgacatatctgtcaatttattaaggttctttaatttttgtcagcattgtttttggacttttcagtgcagaggtcatggacatctttaagaaaacataaaggccattgacttgaagaaactatttgaaacatgtaaattattccaaagtcttgtgtacagcatatgtaaaaagctcttacaactcaataaaagagaagaaatagcccaatttaagaattaacaaaatattttcgtagaatcttcacaataaaaaaataaaaatgaccaataaacacaggaaaagatgctctacatcaggagtcaacaaaatatggcccatgagccaaattcagccatccacctattttcataaagctttatttaaacacagagatgcttgggtttttttagtgtgttatcaatggcttctttcatgctgcaacggtagaactgagtagttgccattgagactgaatcacctgcaaggcttaaaatacttactattcaaccctttatagaaaaagtctactgactcttatgtcgttaataatcagggaagtgcaagttaatactgtaataaaatatatagccactatatggagcatatatgctatataatatatatgctatatatatgttatataatatatatgctctttatatatgctatatatatgctcctatatagccactatgttggctaaaagtgaaaaaatgactactataccaagtgttgacaaagatgaagtgtaattaactaagttagatctatttaaggacatattctctttagtgcgaagacttctccccgacctgatgttgccattatgtgaggaaggagatcccatgaagtgactccatctgacggccagtttctgcctctgaaggaaccccagagcagttgcggtgtcactgtttcagtagccctgttctctcctggtacctccagcatcccaatcaattcctccagatccgcctgagacatacctgacctcagcaaggacaaaaatctcctttcatctgaagaaatcattggctcaagaggaggactgagccacttatttcagtgttctgatagatgtaggggttgctgaaccgttttaagaagctgtaggaaattgtttgatgtaaactccctatatggccacaagggggcaatgcttcttcaaagaagattaacatttgtccaaatacacatattcagcaattagccagagattatccttttaaaatagtaaattatctcctactctgtttcaattcacgtgtctctttcattcaatgcatctatgcatttatccattcatctacctaactagtatctgtatttattctagtctaacagagtggaaaacatcactttggaagtcaacacttttttgaattatacatgttatccttcaagcccacattaacttctgtagtataactttacaaggttttcacccacatacagcccaatatccagtcacactaatctgtgcctaaaattcccttatccattctttttatggggaaatctatcatggtttgtggcccagttcaagcatctccccatccgtactcttctttgactgggtccagaaacagatttcatcaccctttccttcgtcacatcatctagacacactggtgtctttggcaggttccattggctgatacctgagtcttgggactaggttgactgaagacttggactgtgtctctttcgtgaatgaaatgaggcccaagtactgcctaatttagtaggcactttgtggacagtatatatgtattgaatatatgcatatataaattaaaagaaaagaaagcacatcaaaacttaaacaacttttaaaaagcaccttagggtactggggaagaaaaggtttggattgtagattgaggaacgtggaccattgtctcctattggactgcgatggtgttttctttgagtggatttgagatgacaccaaatataaatacaaaaaaatcatttttgtgcttctgaaaaaaatgtgcttctcatgttattttaacttatatgacttataatacagatcatccctatttcaggggtgctttagaatttatcttcaatttctcccttgtatcttgcctgtgttaatatcaaaagttaaatttattctttatattttcatagttgatcgattttgaagtgtgaataaaatatcgaatgtttattcaaactcaggataagagccaccaaaaatgactgcattacggatggttatagatctatatcttctgcagaatttttctatcctctctttccatttaaagatcacagctcctccagaacagataattccagtatttcctattttctttttctaggtacatttaaaaaaatatttaatttacctaatgtgtaatttagaaaaaaatatggagaaaaaataaaattgacttaattgtattatatcatttctgaggatcatctaaaatatggaatgaatacatctgaaaaattgcaacaaaatttaagttctctgaggacaaagggaccatatattctctatgttctgattcatgaccttagcttgtaatggggtattatgcccattgtgtgccctcaataaactttattaatactcacaataaaaaagaaatgccactgtacatgttaatcgtgcggtttcacaagagttcctctcttctaccattgtaaaataaggccctttctattgacatatccagccatcttaaaggtctgaggaaaagttgagggggcttgacagacagaaattctaaactgatgcttatctgtgtgtaaagaaaggattactgattcccaatgaatatatcttcagcaattctaaatttggacaaagtggggaagtgcttcctttgacagagacagctttaagtgaaagcacttgtgaaagggcggggcctgctgaaagaattcagttgagggtgaatttacagagtttcagctggttgggaagactggaagaccacctgggctgtcattgagctctggtgccaggaggaatggacaagatcttaggagcatcatttttagttctgtggcttcaactatgctgtgagttatggaagagaaactccaggatatgttactaacttgggtgaatgagaaaattggggtacagacaaactcatgcaggtagacactttaagaagaaaatattattttggggcctaatgacattttgttatctctctaagcaggggtgagtggccaacagaaggagaaaagtgaccagcagcaggtgaaacaaagtcctcaatctttgatagtccagaaaggagggatttcaattataaactgtgcttatgagaacactgcgtttgactactttccatggtaccaacaattccctgggaaaggccctgcattattgatagccatacgtccagatgtgagtgaaaagaaagaaggaagattcacaatctccttcaataaaagtgccaagcagttctcatcgcatatcatggattcccagcctggagactcagccacctacttctgtgcagcaagcacacagtgctccccaggcacctgaagcctgtacccaaacctgcagttgaggttccagccaaaccccacagtgggagcttacgtaggcagagatgtagcctagttttcatctgcatatgcaagtgataaataaatgtataaacactagtgtggcagtatgagaatggtaattaaagaaaagaaacttagcttaataaatgaccatctctaacaaatgttttattatagttacagtatttgaaattgttacaagcatccagccagttttggggcaactgggaattttatgccttgctgatgggatgcaaatcagtattatgacactggaaaatcatttgccagtttcttataaattgctcttaacataggaccagaaattccactcctaagtatttatctataataaatgaaaatatatcttcacacaagacttttgtttacagcagttttaaccataatagccccaagctggaaacaacccaaatgtccattagctggggaatagaaaaataaattgtggactattcctataatggaatactacagagcaataaaatgcaataagctagtgatacaggtaacacatgacggatctcagaactttatgcttcattgagtgaatggttaaatatactgtggcacatacccacataatggaatatgattcatcaataaaaaacatgaattattgatgcatgcaacaactttgatgaatctcaagggcattatgttgagtgaacaaaagtcaatctcaaaggctatataatgtgtgatttcccttatataacactatcaatatgtaaaaattacaggacagtggttgccagaagttatgggtggggagtgtgtatatagggagtttatttagggtgatggatggaatagttctgtatcctgattgtagttgttagggaaatctatacatatgataaaatgtcacagaagtatatatcaaaaaaagagtgcatataaaaatgggtgaatccaatagcaaagacttggaaccaacccaaatgtccaacaatagactggattaagaaaatgtggcacatatacaccatggaatactatgcagccataaaaaatgaagagttcatgtcctttgtaggaacatggatgaaactggaaaccatcattctcagcaaactatcgcaaggacaaaaaaccaaacaccgcatgttctcactcataggtgggaatagaacaatgagaacacatggacacaggaaggggaacatcacacaccagggcctgttgtggggtgggggatgggggagggaaaccattaggagatatacctaatgctaaatgatgagttaatgggtgcagcacaccaacatggcacatgtatacacatgtaacaaacctgcacattgtgcacgtgtaccctaaaacttaaagtataataataataataataaaagttctttaagcaaaaaaaaaaagggtgaatcagaataagatctgtagtttaataaatactattgtatcaatatcaattttctggttttgatactagtacataatgataatggtacatagctatggttatgtaaaatgttatcattagagaatgctgggtgaaatgtgcaagagaactctgcgttatttttgcaacttctacgtgagtctaaaattatttcaaaataaaaagtaaggatgtagaaaaaagatttttaacaaacatttacaaatttttggaatataaaattttggaatgtggaattttagaacatggttggaacataaactgggcaaccactttggtggattttcataaaactaaatgcgtttctaccacaacccagtgactcacatctaggcatttacccaagaaaaataaaaatgtgtcaacacaaagacttgtacaagaatgttcacaacagttttattcataatagccatcaatttgagaaaacacccataaacaagatactaaatcaataaatttttgtgtcacacacattcaatggaatattaatcagcaataaaatggcctgaaccactgatacacataacagtacaaacaagcctagattatataatgcctagcaaaattgccaaatacaaaagggtatatactgtttgattcaagttatgtgaatttctaaagtagacaaattaatccacggtgaaataaagccaaacagtgattacatctgtgagtgggaattatttgggtggagcacaatgaatttttataagctaaaggaaaagaaatgttctatttcatgataggggtgtggtttacaaggctgtttgcaattttcaaaactcatctaactccatacttatgacttgtttatttcactatatcaattatacttcaattaaaaataaactacagaaattaatcaaataggaaacaaaaacaaaacaattaggggaaaatccaatgccgaataaatttgaagaaataaaagagttaaatactcgataatgttgataatgaggaaaatagaaaatagttaaacaatgcagtacgctgaattctggcccccaaagatgtccatgtcaaaaaccccagagtctatgaatatgctgcttcacatggtatattagttttctagggctgcagtaacaaagtaccgtggactgggtggcttaggacaacagaaatttactgtctcctggttctagtggccaaaagtctggaaccaaggtgttgcagagccatgctccttctggggcgctagggaagatttgtttcagacctcgttccgagtatctgatggtcacaagcatcccttagcttagagatggtcatgtcctccctgtgtctcctcccatcatctttcctctgtttgtgtctctgtctcttcacgtgacattcttttcataagggcaccagtcttattggactaagggcccgcactactccagtaggatctcatttcaacttaactaatgacattggcaatgaccctatttccaaaaaagttcacattctaagcttctagaggttagaacttcaacatatgaattttctggggatacaatttaaccgaataacatatagtgaaaggaactttacatatatgattaattcaaaaatcttgaaatgagaagatttatcctcaattatccaggcagacccagtggaatcacaaggatctctataaaagggaggcagtagacttggaatgaaagaaagcaatgtgatgagagaatgagaacagcctcgaagttggaaaaggcaaaaaaaaaaaaaaaaagaaaaaagacagattattccccatagccaccagaaggaactcagacctgctggtaccttgactttagtccagtgaaactgattttggatttaagatctccagaattgcaaaataataaatgtgtgctgttttaagccactgattttgtggtaatttcttatagccacaataggagactaataaattcaataataggagagattaaaaaggagacatgtctggagataaagtagaaattaaaaaaaaattagcataagttaagtacaatttaagccaataaattttaaaactttaaaaagtagaaacaatttgaatgaaaaacatatactaccaaaagtaactcaagaagaaatagaaaaactaagtagatttataaccattaaattatttgataattggaaatgaaaatccctaaagatttagtaatagaagggaaatttttaacctgcatgtgcgcccactacaaaattaaaaacaagacacatgctggatgcatctgtaaataatataaccaataagattttagaaattaaggttagatggggaactcttacaaataaataagaaaacattcaaaataagaagagacaaggatataaaaggcaattcaaaaagaagaaataggaatggccactaaatatgtaaaacatcaacttccacagaactcgaggaaatcaaattaaaataaattattgtttcatttctatttgatcaacaaaatctaaaatatctggtaacattaagtattggtaggaatacatggagatgaagctgttacacttttccagatgaagaaaaacaccacacagagaatttaggataacaatttgcctaaactagttatgaatttgcacatatctaataatccagcaatacaaatttctgatatctacataaaggtagtcaaaatgtaaactaggaggcatttacaaggatgctcactgcaaccctctttaaaaataagtataatcacaagaaaaaaacaaccccatcaataagtgggcgaaggacatgaacagacacttctcaagacatttatgcagcctacagacacatgaaaaaatgctcatcatcactggccatcagagaaatgcaaatcaaaaccacaatgagataccatctcacaccagttagaatggcaatcattaaaaagtcaggaccacttttacactgttagtgggagtgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccatacaaatgaagagttcatgtcctttgtagggatgtggatgaagctggaaaccaacattctcagcaaactatcgcaaggacagaaaaccaaacaccacgtgttctgactcataggtgggaattgaacaatgagaacgcatggacacaggaaggggaacatcacacaccggggcctgttgtggggtgaggggagcggggagggatagcatttggagatatacctaatgtaaatgacgagttaatgggtgcagacaccaacatggtatatgtatacatatgtaacaaacctgcacgttgtgcacatgtatcctagaacttaaagtataataaaaaaaatacaatacattcattaaaaaaaagtataatcaatagtggaataaaaaatagtggtttagtcatacaatggaagtattagccattacaagcaaagaagtggttctatacatattttcttagatgaatcttacaaataaaatgttggatgtaaaagcagaatgatacatactgcatggcaccattaataagaaatcttaaaatacaaaataatgcagtatattgttttgtaatacatacctgtaatggttaaattctttttttttttgagacggcatcttgctctgtcgcccaggctggagtgcagtggcacgatctcggctcactgcaagctccctctcctggattcacgccattctcctgtctcagcctccggagtagctgggactaaagggagcgccaccacgcccggctaatttttgtgtgtgtgtgtttttagtagagacggggtctcaccatgttagacaggatggtctcgataccctgacctcgtgatctgcccacatcggcctcccaaagtgctgggattacaggcgtcagccaccgtgcccggcctgtaagggttaaattttaaaagacatgcgtggaaacttcccaagagtggttactatctttgaaagaataaaaggaacaaggactattgttctagctttgtctgaaatgtttgagaaaatctgaaatgtagagagagaaagaatatttttagaaaacatagcaaaattcatcatctgtttatgtgtttattctcattgctggatacgaaggtgcctgctatataattttctgtacttttgctcatgataattatttcataaatttaaaaaataatttttaaatggatagcgacaatcatagtttttactatcttcaccagtccacagaagagaatagcaccttcattacctacaactttgccagatgtatttctggtaggccacataaatggcaataaaacatcaattggaaaaaatctctaatttatgaataaaaggatgttcaacctgaaataaacaacccaagactctttcccctgaaccacaatgcatacattttcaatatattaaaaagaggatgtggaaaaaaaatccaattagttacctcttagcaatgggagatgtggccacaaaatgtcagcattttgtgaatattaactcccctgggctctcaaagtttattttacttccttttttagcagtttgaaaaatcgaagaagaaattggaatagtatttatgtctgattagagtggctttcattggactgaaatattcaagaataaagtagaatacagtgcctaggatgaattcgtggtcagcatgagaagagggctgttgtcaagtatatgagagagaggaagaaatgggaagagctgggagtctcaacagtgattctgtggcttcatacagatgtgagtttggggatttctacaaagaaccaggaagagtctgaggacagtttgccacagaatcactcaactattcccatttggatttctttatggggcagtccaacaaaaatacagcttttggaatttggtgctttgacataaactgctctatcagatgaagtttcagcataaagtggaaaagaatcttcattctttcaatgtccaaagagggaaatatttttattttggacatttatactattaatagttttgaatatttttactgataaagcagcattttgtgagaagccttgtcttcctgataattattaaaaattatagaattgcaccaaacagtacacatgcactcatggcaacagcatagctaaagatttgaattcagagggcccatggattctcccatcctagaacttcaaataaaattaagcatagagttatagtagaaataataggcctttgccgttactattgacagtagaacacacaactggagaaaatacagaacctgggagtcttttttttttaatctcatttgtctgagctgttgctttgccattgtgaagttccaattcccttggtttgatgggtaagtaggaaggacgggaggtgatgacttctggtttgtctcctgtgtcaaagccaaggattggtgagcagcttcacctttgactcaggttggtagcaagtgaacaatcaaaacatgaatgtatatttgtaatcaaagccatgattcataataaattggtttcagataagcccctcagatttatcacagatcaatttcctaaacttggaaattttaaatgactaatctccttttaagaattccttcaatattgtttcatgcatgtcctttaccagatataatcctttgtcatttgttaattaaattataagaaagggcaaaacgatgtttaggatagaaccaatttcccagcctagggattatcatagcacattcacacttgacccacccagaaaccacatttcagaggcagcttccatacagaactgagggaccctgcacctgtactgtcagggtacagagcagggctatttcaacaggaaggaaatcctgccatcatactgcttcccagtctactgtgagtattcatggtctccatctacttaggtacaaataattgcaaaccagagcatggatacctctcagcactcagaggtgaaacgggactaaggagtagatgtctcaaacaatgagaaactattccctgcaccactcagtgatatgctattttgacctttataaaagaactggaaatgttttagagaccttgtctgcactttctttcttagctatctcttggtccctttatattaattcgtccattaagttagtgaaactagaggctgggttcacacatataatcccagcactttgggaagccaagataaggtcacttgaggccaggagtttgagaccagtctgggcaacgtagagagactccatctctacaaagtaaaataaaaatttagccaggcctggtagctcgcaactggagtcctagccatttgggaggctgcggtgacaaaattacttgagcctaggagttccaggctgcagtgagttctgattgtgccactgcacttcagtctgggtgacaaagagagacccccaactctaaaataaaaatttttctatttaaatttttaaaaaagacaatgaaatcacatggaagattaacatctaaattccatacaatcacgtaacagcatacaaaaaattcagccaccaacttctgtggtattgacatgcacaaagttcttgcaaccttcagataacacgttctgtgggagtatattatagcattgtatcatttgcatcacagagagatcttgtatgcttatcatgacaaacaatgtcttatgcttatcattaaaaattttaaaaatgcccagccacagaatgtaacaagtgagactgaatactttggatcaatgggatagaaaatgtgatatcaggacaattctaggacacatgatctaagaagtataattctacttgtgaaggcaacaggactgaatatactgatcctcctcagtctagtaaataaaacttagtgtcagattttgaaatgattacattttattgctgttataatttcataaagagataaaaaactgagcagcttctgaaagtcgagaaggactgatttttatcatttgattttgaagtagctttacttattatagaacttaactagggccctagacctcagtaaggaggaagaaagagatgcagtaattgtttagaataggactgcctttcacagagaaagtcaaatatctgagtatttttcttttaaatttaattagtttctgatggcaaaaagtaaatatatgctaaatgaataatatcaatgtatgtcaactggttcaactgcagttcccctcaatacaaattgcttttcttatatcccttttctaggttctgtctatcctaatgactagggaaagacaactagacaaagtaaagattcaggggtgagccagacatttttcctcatctgtgcatagccatgtagtctatgaacatgagactcaatttcctgtttggggagatagcatcagaacccaggaactacatatacacaccgcagggccctggtaggcactgaactttgagcttcaggcagcacaactcacatttgtgcaaagagctacatgccacatgctgttctccagcctgctgtgtgtatttgtggccttcagctactctggtatggatggttccaagtgtgagtaaaaatgttaaggatggaaggattccaaacaggcatatggtatttctcatggacttgaggaggaaaggagaaattgtaaaaaagcgagcatattatgattttagtttggtttgtctctgggtcctaaattagtctagctcttacgatattttattcactatatcaaaggatcagctctgttttctgatttttcccacaggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttggggaactcacagtgtttgaagtgatagtaaaagcaaaacaaaaaccctagggctcaataagagaacccctctactccccatcctttgctacaggagccaatctgaaatgcacacctgcagatctcaggcaagagagggtagtgactgtggtctgtggatttaatctgtggtctggatcagatgatttaattccaagtaaaacctccttctatctcacttggaaacaggtgttcagagcaactttcttctaatacttcaatttttacttaaaatagatcatacagaaaatgtgtaaagttgtctaaagttggaaagacttccacataataacttaaagtggcagtctcacttaacgatgctcacagcagaaatctgggtctagttatcttgaatcaccataaaaatcatttccttagccctttcctcttaagctttatgtcagttaggatacaatcagggaagcagaaccatcgtgaaagatgtagaataagattaattataaggattagacctcatgcaattgctggaacgggtggctctcggaagttacttagttgtttatgtttttatgaaattgtaacaggaataaaatgtaatcttttcaaaatctgacactgagttttatgtactaggctgaagaggatcaggacattcagtcctattggcttcacaagtagaatagtacttcttagatcatgtgtcctagaattctcctgataccacatttctatcccattaatccaaactattcagtctcacttgttaaattctgtggctgggcatgtttttcatgtgtaaaataaagtcgtgataagcatgccagatttctgtgatacgatgccataatctgctcttactcctatgcaaagctgtttgctgaatttactctaggtcagctagactcacatttgggaaggagagttgaacatggacaagagcatgcaaaagctgtgatttgtaaagacattttggaacccatggtgacaggtggaacccacgaggacaaactaaaacttgtctgtctcttacctccttcaatctcatagtgttggtgaccttcagaagaaatggtgttatttgctatcatgctccctgggtacttggcccaagaaaaagagaagctgaaagaggagatctggggggagtgggggagttgtgaatcaacaataagatgagttagcagatcagagcaacatatgtgagttgccacagtgcctggagcctggcacctgccttacacaatttttttcaacttaatcgagaacaatatagggaaggattttcttagaaatatatttccaggtagttacgacgagacagtacaaagttaccacaatacccccaccttgtaaacttgacatccatatgcacctcttttaatagcacttagctttcaaataaaggcaattttaaaaagcatacttcctgccaatatgatgccactgttcttcattcaaccacacataccctaaccctctcccctaaagagaatacaaagtatttattcatctttgggtgatgttctttcctcttctagctgagtcacactctcccattgatatcctgtagtttagcttctgagatataacaagctataagagtaacttattaacatatctttcactattatgtataggcaaatgggaggagagtaaaaaatggttgacatgtattttaatattttcatatcacaatgaaaaagaaatgtttataacagtatagtctttttttccacaaatggtcacatgattgtagctggtttctataactacctcttccattacccatttcataatctgttttcagcaagcacctcaactcactggtacacttgactttctataaaacaagctccttggtcaggagcaatgttatacagaatgccataaagttgagtaaggaattctctaagcccaccactgtggttttgccagaagcactgcagatgtggaaggaaagtccatattcagaatgtctaagtggactaaaacaaagcaaaacttgccagcagccagagaaagttgatatatcatgatatatcatgatatatcatgtctttaagaatgattgctgaattctcatcaaaatcaacagaagccaaagaggaaaaagtatttttagagtacttacaaaacaaacaaacaaacaaacaaacaaaaaaactctctagctagcttcctatgaacatgaaagtctaattttaaaccctttgtcaaaaatcattgttaaaaaggtggaaagtcagtgcacagattgggaaattatatttgcattggtgtatttctgaaaaagattcaaatgcagaatatataaaaaacttgtacaagtcaacaagcaatgagaaaacaatacaaatggccaaaacttgaagagacacttcagaaatatgatatctaatagtaataagcatacacaaaaagcacttaatataattactcattaggaaaatgaaaatgaaaccccattgagtgatccccctgtgccctttcagcaccccagttgtattaatgtagccaggaggaaatgaccacaagaggataatgaaaaatagtgactacttccaggggaagggatggccaagtaggttttctagaaacttctgttaaattaagtttagcctaaagctgcctccttatttatttaaaactcagggcaaaggtttctccatacatagggccctgtaacctaacaggatgcataaacaggctacagtctgctctctaccaatccctaagtttcggccataggtggccaactgttcaaacatgttcaaataaggcaaatgccaagctttaaccaatccatctgtttctgtaccttacttcctttttctataagtcactttactttctctgtccataaatattctttgaccatgtggcagtgacagagtctctctgaacctgttctggtctggtggggggctgcctgaatctctaatcgttctttgcttaattaaactctgtaaaatttaattcgtctaaagtttttcttttaacatgtccatcattgaaccatgttcagtggaagaagaaaaagcagtaacaggctaaagaccggaacactgaaggaaagcaggttttactaggaaaaaagaaagttggtattcattggccatactatatgtcaggcactatttatacatttcaaattcattacctaatttaagcatcatacaccctacgagataggttttagtcttccaattttttatatttgggaaatgagacacagctttccctaactttgaaaagcatctctaactaaagtcagccagggtgtaacatcttagagggctcctaaaaaatcaaagtttggactatggagaagcaaatagccacaaagcagcagcattggctttctcagtgaggatgacaagatgacaaacctaggcacaaattgcctcaggatcaacagatggaggaaatcaccgactaagtatttaagagtgctgaatgtatcagtgagtctcttctacagtagtgtgctatgaagcacaagaggctagagggaaagatgagatactattccttaaacactccaagcgggcttccatatcaaggcctttgcccactctgcctgcaatgctatacccccacaaaacctcatggtgtagctctgaactcctctacgtctttacgcaaaagtcaccactttgtgaagcctttatcgaaatctttctattgtatattccttctttgagaatcaggctctagcgtattccacgtgttgagaactaaagcaccaagttctgaagcactgccacctggtgtcccgctgaactatttggtgaggtttacgctggcttccctgctgccctccagtgttcacgggctaagctgtgatgaagcctggttgcaataggagctagcatttctgaaccagtcagtaaccttcccatggtagtaatcatgtgagacaggattcagcaggactggctgagacttttttttttctttgaaggaagcaatttttatcccttacgcagcttgtccctgctactgtgtcttgtctccattgcctggatccagacctcacaagttatttatgtatttatgtatttatttatttatttatttattccaaggcagaagaatttttcttagtacagaacaaaatggagtctcctatgtctacttctttctacacagacacagtaacaatctgttctctctttcttttccccacatttcccccttttcttttctacaaaaccgccatcgtcatcactgcccgttctcgatggtcgctgtctcttcggagctgttgggtacacctcccagacggggcggccgggcagaggcactcacttcctagacggggcggccgggcagaggcgctggctgggacttttttaaatttcatttttaaaatatttttcccttaatatgtgaggttgattgatttcaaaatggcaaatataatatatgggatggtttaagctaatagaataccttggaaacaaaggttggcattattgcacaaggtgggaagtttttctctattaagtgagagttcatctactgctctgtcccttactgtagtatagaaatatcctaagaagtgagaacaagagtcaatgatggagagaaataagccattgtagggaacacagtgcagcatactctctccatgttatcatatgctgcccaacctcccaatatagcatcataacgccactgatttcccactaacagtaagaaacatgatagaacatggatatgtattatagtacataaaatatgctatgcaaattgcaaaatgcccctcggaaaaatactgaattttatcttgtggatagactgcactgcaatttcagatacagtctcccaaccccccaatattttctatattgaatgcatctggttgagtgcctaagatacagaagttattgtattagatgatttattcggttggtgtaaaagtaatttctgctttttccattacttataatgtaatggcataaccattatataggcttggattgcatttctggacctaccactcattggttgaattatcttgagcaaattacttaataacttttatgcttcagtctccttatccctacaatgtggatattgatagtacttactacaaagggttattttgagaaataaacaaaatgacaaatgccaatgcttagcccagtaccaacaaaaagctactggttacttacagaaaaggaaattgaatatgagagagattaaatgtcttgcctagcatcacaaagtgtcagagttgagccttccctccatgccttatgtagagcagataccttttctcaccccaagaataactctctatctcattacagtgctatattgtctttatagagcttatcaccgtatagaattatcttattttgtaaaaactcatttatttaacttcttctcattgcactctagtcccttttctatctcttcaccaccatgttctccatgcctggaacaatgcctagcacacaggagacacaaacaatacatgtttgttgaatgaatgcacaaaaggtaaaattatgtccagagtccttgcaattcaaatattaatataacagtttaagctggattaatctttgtgttatttatccagaattgtcaagatttatatcctgtaagtttcttaacgtaatatttaaatatgtaaaggctaaatagttgaatactagctttggtttatctacattggtttatttttgcactttgggggaattaataaataatcttactaaaaattttatctataaatccctcactttactcactgtggatatgaggtagaaaaaattctgaggcatttttctctgtagtgcatgcatcttatcttttatgttgcaaaagtttttcagaggactcatgtatatgtatatatttttatgttttaaaaaattctgtgtgcacacatacacacacacacacacacacacacacactccttgcataagagttgatatacaggcccactgtttgctcaaaacagagaaagcaaattgaccttgtttcccttcactatcagggtgggtacatttagaatcctccctgatatattaggctgttaagaatgataaagattgatattactagttgagttgtcctgtggccaaagtggggaggaaggaaactaggatcatgcactcttccagaaagagaatctcgtaaggctgtatttagttgccaacaggcttggcctttacttcaggtcaaatgtgtggctataccttgcaggattctgtcctactattatagatagaggaattctccctgctgttagaggtatatcttcttgatctggacactgctccttcaacatgtgggtgaatttatcagtggatcggtgttctcaccagaaatgagctccacagcatgtaggctttctgagtgattgtggccatgacttcactctcctatgataaagttacctgaatgctatgatcttctccatgcatctggagaagaaactacagaaaagaaactactacagcaaagacttggaaccaagccaaatgcccatcagtgatagactggattaagaaaatgtggcacatatacaccatggaatactatgcaatcataagcaggatgagtttatgtccttggcagggacatgaatgaagctggaaaccatcattctcagcaagctatcacaagaccagaaaaccaaatactgcatgttctcactcataagtgggagttgaacaatgagaacacatggacacagggaggggaatatcgcacaccagggtctgtcaggggatgggggactaggggaggtataacattagcagaaatacctaacgtaggtgacaggtcgatgggtgcagcaaaccaccagggcatgtgtatacctatgtaacaaagctgcacgttctgaacatgtaccccaggacttaaagtatgatttaaaaaaaagaatggcttgtttgtctagcagccatccctaaccctagtcctcatgcttctgaactaggagtcattattgaggcttccaggatttcctttactacccatacatttatctccttttctgggaaggaaagctagaagttaaccattgagatactttctaatcctgttctaattttttagaacgtgatttaaatgtatgtggaaagtgctgtcccctgattttagtacataccccatgctgtttcctttgcttacttcagttgttcactggaaaggttttaaaggcacttcatacactaaatacctagaggttaaatttatattctgaaaaaaattaatgctatcttatattattaaatttcccttggatatatcttatttctccaattatattttgggctcacagggaatagggaatgttgctttgtaatctttttttctttcttttcctctcccctagatgaggctgtagctttgtaatttttaattcctcagagctcctagggaaattcaaagcacaaaaattactgtttaaaaaatacatgcatattgaatcaaactaacgttatatctggactgtgacagaagcaagacagcataattcttatttacttttaaacaactttattggagtatgtttacgttccataaattcatccattttaaatgtatggttcagtgatttttaattaataactgatttatgaaactattaccataatctatttgtaaatccttttcaacactctagaaagatccttcatgccaaacttatagttaatctctaacccaaccctggccccaggcaaccggcttacatctttatagatcttccttttctgaacatttcatataaatggaatcactcaatatgtaatcttttgtggctggattctttttcttaaaatagtatttttgaggctcatctgtgttgtagcatatattatgttttattttatttatttcatttttgcttatttattttattttatttattatttatttatttttgttgccgaatatcattcacatcttgtatgaacatactgcattttgtttattcattcaccagctgatggacatttgggttgttctcatttttttagccttaataaagaatatccacaaattagacttccattatttttagaacatatctaacatgtaaaacattcatggtgcatcacaaatgtaggtggcatatcagattccaattataaagtctagagctagacagatatatgttctaattcttaatatgccacttaggtaattgaccttgagtgaattatttaatctccttgagctttgggttattttttgtttgtaaattagaaacagtaatgtctctattgcatgactttcttattagatagatgtacataaagaaaaaggtaatttagatgtgtgcacatttataatttgagggggattcaaaagttgttttttaatgtttgaagattcaaagaaaaatgcttttcctgccacaaatgccatcccacctgtaactccctctaaatttgaataatagcagtccacagttaggcagcgcacttctgaaagggtgtcaattctcgttgtgttccacactcatgggggatttcctcaaagtttatgaagttggcctgaagaaagcagttacttcgactcctctttgtgaaccacaggaaactgaacatagggcagagcgtttctaggacatttatgggagctggtctctgattggctaggcaaccagatgcagaatcctgttttctgaagcagaatatttccacagattttggctgcaaaacgtttttctgctgtgggtacgtgagcaggaaacatggagaagaatcctttggcagccccattactaatcctctggtttcatcttgactgtaagtccaggggttacaggagacattcttagtctggggtgatgatgaggaaggaggaggatgcagtcagacactctaggttttatttggggatgtgtgaagaaaatgccaactctgtagagagaccaatttctatgtctgactcttttttaaaaaaacaggcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccttgtttgtaatgactttaaatggggatgaaaagaagaaaggacgaataagtgccactcttaataccaaggagggttacagctatttgtacatcaaaggatcccagcctgaagactcagccacatacctctgtgcctttacacagtgctgttcaggcacctgcagcccatacgcaaacctgtgtctggtgttgcactgttaccagcattgacaaagaaccatgagtaggatggaaaagacaagttcgttgaattacagttttttttcaagaggattgtgcaaacatagaaaaataagcatgctagtgatcataactaactaccacaagagcaaattaagtaaacatattccttatgacagatagatgtcagagtgctaatgaagcataacacatgacctggtaactgggccgttactaaacaatactaaccccagctcccaacagctcattaaccacatcatggagtcagacccattgcctgctcttttggcatgattctgaaagaacccaatagttactcaaatctatctaaaacaatctgggtaaacaaaggcgatatttaccccctcattgttgctatgtcctgaaaacgaattcttctattatactttatcacagcacaaaaggagcatgtcggcatgcccctccctcacacacctggcctggaaatatgcatgtttaataccagaacaggtgatgctgcctcctttaatccattggggattttggttttgctttagttcaacttttcccccacatgaacatttgtatttttatttcttctcacatgtggctattttcatttttaaatatcactgataatatcataaaggagcactgatgaaggaccttcactattttacgtggtctataccccagcttgtactgtgattgtgatattggatgactaactgaactctattatcaaagtctcttcatttgtaatttccaggtatattaagtaggctgagtgtttggtgctctcctccttttgcagatttccaaacaacccaccagtttaaggtcccacttgtactctagaggcatctaattctaagcgttcttgggggctgttaagatgaagtaagttgcttctgggcctcctcatctaaaagctagaatttcaactttctctaaacatctacattaataattatttatccagctcctgtccagtttcctaaattatgctgctattgcattttctctctcttttgtggatttatgtttttaaaaatattattgttattatcacatatttaggaaaaaaagctggtacattttaaaaataataatggagtgtatacaaatctctgactggacccatttagagatatatatatatagagagagaattacttttttcaaaatttattcacaaggtagtaatgaatctatttgactatcagatcagaagcggctaaatttgtaatattatttgaacatatatggaatcagaagggtatagcacaggactgagtgcggagaagctatggttcattgtaccctagtgtcggtggagaagaactacacaaaagaagactgatcactgttccagctgctagtcaaattcccaaaccagctctccattattggcataaagatcaatggaagaatttctaatatttccagcaatgatcttgaggcttgaactaactctgaattggtagaatcaaaaggcatgagtaaaataaaagatgaacatctgactcatttgtgtgtggctgcaacacaatgcctcacagtctcccgcatgtcaaggcacacatagaaattaattacattcatacaacacttcagtgtggaatgacgctgcttgaaaccagcccatgactccaacttccttgagaactctgcctgccttaagccacgatgagatagagatcttcccacacacacgatcaagaaaaatgtaaatctgtggtgcatggtccttacaaaaatatccctatctttatgaaagctgtatgtaaccaagtaaatatggatgaaaattttcagtgtctttggattctaaaactgatctgaaattgaaaataatgtgtcaaattctgattatttatagagacacaggcatgttcttgtaaattttgttagtttagacacatggaaagagaagagtgagtgaaatataaaaatgttaaataagaaacacagatctctgttgattgcagggccccaacctgagcaatcagccacctgctcctgtactgtggctgcacagagctcttgttacctctgatcattgccaccaggtcttctgtgccagtgcagaagcacaaggctggcttttgaaaagaagtttggtgaaacaggcagatgtttcagatcaagctattagagactagcagaaatcagccagaggaagcatacatttttattgttgatttctcacaagttctcaaaaagactatttttcattgaactccagagcttttgtggcttgctgaataacaaactgttgtacaactcacttaagcaagtgccattttactatctcatgatacttctgctccttgtgatgctgactgcagctagggtcctctgggggcttgcctgactagaacccctggagctcacttccatacccggagccttggtgggaatgcggaaggctgggctcatctctcatcccaactattctcagggctttcattacacatggcctctgcatgtggtctctcatcaagatctctctagggcttccaatattacaaaagtggaaggtgccaggcctttttaatgtttaggccagaactgccacaatattatttctactgcattctcatgcatacataagaaccatgaatgtgacattacttggaaaaggggcctctgtaaatataattaaaattgagtcatagagccaacccagagtcaacatagaagggaaatacacaagggcatgaatatcagaagcacgattttgagggcatctttggatactaactcccacaagagctaactaagtaaacatattcctatgccagatagatatcagagtgctaatgaagcataacacatgaccttgataatccagtaattatcaaggtcatgtcaatttgaacttccaaatactgctcgtatctgtttctctatttctatattgcttactgctttcctaatttaggcattcagcacctctcacttggatgattgcaatggcttcctaattgtcttcctgcctctattctcaactctttgaatctaacttctacatggcaactagagttattataaaatgtatctaataagatcacttcctgcctccctttgggtagtaaggaaccactagaagttgaaactctgtattaaaactacaaggccggctgggtgtggtggctcatgtccgtaatcccagcactttgggaggccgaggcaggtggatcacctgaggtcaggagttcgagaccagcctgaacaacatggcgaaaccccgtctctactaaaaatacaaaaatttgccggacgtggtggcatgctcctataatcccagctactcaagaggctgagacaggagaattgcttgaacccaggaggtggaggttgcagtgagctgagattgccactgcacttcagcctgagtgacaaagcaagactccgtctcaaaaagaaacaaacaaacaaacaaacaaaaatacaaggccatctacagaatcctgtttaccttctattttaatcttccatccttctctcatatatgtaatatatatatatttatattatatatatttatatattatatatgtatatttaaattctaaccctttatgtgaatattaagggccttcctaaatctgaccccttttcccagaatatatttttcccattgtaatatgcacacaggtctactcaccctttatggcccaattcaggcattatttattttttatctgagatttcatagaatctcatagaatctgagatttcatagaataacacttgtaacatcttattataaatatttttgaatctgatcctctcttacaattgttttgacaaaaatatttgccactgagagctattatatgtttatattcaatggaaatgtttcctactaggaaatgcagagattcagtctaagagtgcagagatttcttttactccttgaaccaatgcatggccagcttcccttctcttcctttagtaaatttccacttccaaccataagatctagagagaggctacaagacagaccatgctgcgagttgggaaagggcaagcttgacccgggcgagattcctctgtctgggtttatgcctcctacgtaaactgcaccagtactgctgccctggatgaagagaagaggatttctaaagcccccacaggtgctccttgcacactccttgctcttcttgaatggggaaggagtccttattgccttaaaattgttagctttgtcttcattttgagatccaaatccaatattcctacgaaggaaaaaaaagcatcccagtggcatgcatttcaaaagtttatcttaattcacaagatttgccatttttcagcacatccgaaaactgcttcttggtctgtttccatttcatgcagtaattcagatttagattcactttttaccctacacaaaatgttgagatttccgccattaatacatttacaaggcaacactttaaagacattagatttcttgtagtgggttgaatgatgacagaagatatgtccatgtcctaatccctagaaatagtgaatgtggtgttatttgaaaaagggtctttgcaaatgtaattgagttaagaatatcaagttaagatcaccctggattattcaggtaggccctaaatccaatgacaactgttcttttttttttttttttttttttttttttttttttttttgttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccgacaactgttcttttaagaaacacacggatgaggctgggcacattggctcatgcctgtaatcccagcactttgggaggctgaggcgggcgaatcacctgaggtcaggagttcgagactagcctggccaacatggtgaaaccctgtctttactaaaaatacaaaaattagccaggcatggtgatgcacacctgtaatcacagctactcgggaggctgaggcaggagaatcgcttgaacctgggaggtggaggttgctgtgagccactgcactccagcctgggtaacatagtgagactctgtctcaggaaaaaaaaaaaaaaaaaaaaagaagcacacagatgagaaggccatctaaagacagcggggtagaggttgcaattatgcagccacatccaagggatgcctggagccaccggaggctggaaaagatgaggaaggatcctcccctagaacgttcagagggaacatggccctgctgacaccttaatttcagacttctggcctctaggggtataaagaaaatacatttttgtcaagccaccaagtttgtttgctacggcaaccctaggaaagtagtatctcctaaaggtgatatttctaaatagctacaaccaaaccttgattgtttttatagaagggcacattgtcaaccaataccatttgaatatggtattgatatggttctaatattttaatactttttggaatattttaagtttaaatcgtgacacagtgtatatacaaacacacactttttttttttatcatttaatgaacacctgagtatccacaatttacccgctattagagtaggacatgttggtgaataatagacaaatactttccaatagaaattgattatctgttagataagactttttttctaattatattaatgtcttccctcatcacgctggcatgtgtaaaagtaacatagtgggatggcagacatgatctctaaattggataatttaccagggaaatcagggtgacgaaagagaaatttgtatttcttatcgtctgttttgaggtaatgcgttgtctaacaataaatcacaagtgtctcccacatttattaaaaagtctgtgacctaatatgtcccattaaggcacttataagcatgtgctacatggcacaacatgatgcttagtgacaatggaagcgacaaaatggaactttctcttttcttcggatgccctagttttaaatcacagactccatttttaagaggcaaattattcctccttgaacaatgtcaccatcagtaaactcttttcttccaatccttgacacacatacataccacctaaattagaaagcagctttattaataaaataatctgttgtcaaatcagcaatgtttgagtccaccacaggggggcagcatcggcaaacatagactctcctctgagagggtgggcaaaatagtgtgattggttttctcaacttgcagtcacctctttccctttctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacgtgagtttgagacgtccctgactgcttccagagaataaatccaacaggatagagaagtatctgcaggcagggaatggactttctgtttgagaaacaagagttaagacaaagggagagaaacagagagaaagagacagaatggataaaggttgagggagatgggaagggagacgtggacagaaaggggaaaaaagaaaagaggagtgagagagacctgcgtagctcaggagctaaatatctaatctgattttatgtgatgcttcccattgtctttctaaacagaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggcacagtgctccccaagcacctgctgcctgtctccaaatcttgccctgggtcttcaggagcagatcatcctactctccccaaagagcaggcgccagagaaagccaaagtcacaatgtctgtgaggatctcgagcaactcctccccatggcagtaggaatgcatgtagaaattcactctgttaagacctggaagagtttagcagttttagttcctaaaacttaactaccggttttcttctacacaggtgtctcaaagaattctaattgtcttaggaagaatcggtggattttaacgaattgtgatacagatatttatataaaaagtcatctttcagtgcagtggtccccaacatttttggcatcagggaccggttttgttgaagacaatttttccacggagagggtggggtgatggtttcgggatgaaactgtttacctcagattatcaggaattagttagattatcttaaggagcgagcagcctagatccctcgcatgcgcggttcgcaatagggttcgggctcctatgagaatctaatgccactgctgatctcacaggaggcggagctctggcagtaatgctcacctgccgctcacttcctgctctgcggccaggttcctaacaggccacagaatggtacagattccctgccgccaggggtttgggacccctgtttgggtggtagcagaggtttccaagcagtttctttaaggttttagctcaattgtattgcggaagatttgaaaattaaacatttttcattatgtacacaaaacttaaaagaagtttacgaccaactccctgaagagtcacctctgtagaactcatctgcttcaatgcaacgcagtccaacatagcataaagattatgcaggcggtaaccacctttccagagaactgagtgaaaagagctctttttaaaatgaggagtttagacgaaactggaaggtgacccatgaagagatttaggcatggtctctttttcactcttccaactgcaattatattcgccaagcccagatgaagctgatgattcaagttccgttagccatgttcattggtctaactacggggaaaagtcagccatagatttcaaagtgtgttcactgacttgaccaattactttatttctcagtacttacaaagatttttatcttgggaaagagaggataaaaatacaactgtattggagagtttaaacattaaaatcaactgagattggtcagctaaatggtcaaataaagtttttgcacctttttaataaaaagttttgtagccataaaattattgtgatgaaaattttgtaacataggaattaagttaatttatcaaatgaacaaagtcaaatacaaaatagtactatgccacttataaaacaaaataacatatgtatatagaaaaatatggatgggagcacacgcatgtttaggttaatttctaagagcaccgtaattatttagtagttgttttcatccattataacatttccaaggctatttcagagttgtgccaaaaacagttatgttaaaattattgtaaaaattattttctcctcttctgtcatagccttggcccttttgcacacggatcctctcaaactgacctttttttcgggggaggggaggggaaggtgggtctttctcccacaaagttttccttcctttctctttttttctttcatacgttttctgtgtttttctgctacaatcatgccaaagtacaaaataatactaattaacaaaatcacaagcactagaaaacagacatgaattataaaaggcctcataaataattctggaaagatcaaaaagtgacctttacagccagtaggggagtgaattcatccatcaaaacagctgccagagatgattcacatcagaagtaaaaaaacaaaaaacaaaaaacaaaaaccacaaacaccaccttaccagtataattaggatctcgttttgattctttaccaaatttaaggagagtatggtctgatatttcttggtttccctcactgattgtttctcttttcttcccagtgtatcttttattaagcacacatgaggggctgtcatcctttgattctccaatattttctgtctgggagaccccatgtacagaaacaaggggtggactgacagtttcaatttgactctagtgtcaaattgaagtgtttggctacttcctccaaaatctttcttcataggattttttttttgaaggttttctcaaagactacacctaactactgtacaaaaacacatcagtagagtctgcttaaaagacctccttcaaggtttcagtgagcatagatcgcaccactgcactccagcctgggtgacagagtgagactccatctcaaaatataaaatgaaataaaataaaaataaaaataaaaataaaataaaagacctccttcagaaggcattaatcatgtctttcttcctttttatctctctttctttccttccttccttccttcctttcttttttttctttctttttttttgtcacatccaatctgtatctccatgctgtctagagtgattagagtgattctctatcctttacagcaatggggcgcattagtccacatctctgtttttcttgctcactcacaggagataagattaaaaacaggtaaggataatattgttttatgaagcaggtattataatttcaaacttataaagaaagaaattgaaacctcaagatattaagtaacttacatctactcacttataagaatggataaagttcaaatatatgagaatatcagtactggttaggctacacatcagctggaactctcatacattgctgataggaaagagaaatgatcagcactttgtaaaacaggttggcagttcttacaaagttaaacttcacttacaatatgattcatcaatccctctcctacgtatttagccaagagaaataaaagttatgttcgcataaaaatttccatgtgaatgtttacagaagcttaattcataattactaaaacctgggaacgatcagatgtccttcacctggagaatggttaaacacattgtggttcatccatatgattgagtactactcagcaacaaaaagaaatgaaatattgactcatgcaacaacatggatgaatcttcaacgtgtcttggtaaataaaagaaactaagtctaaaggactacatattgtgtgagtttatttatattattaatacatatgggtagaagcaaaactataaagataggaaacagatcaaagggttggtgagaactgtaccatagacctgtataccgcaaaaagtaaatcttactgtgtataaattttttaataattagaatgtgagtggaaccccaaaagaaatagaaagtgtaacaaatgcttccaacaatattatagtgaataatgtaaacacagtgacactgtctttaatgtggaagaaaataactaacctaaataatttttgaaaacagtattttgaatagatattgtaagactaaaggcaaaagaatggcacacaaataccattctgtagttaataaatttgtttctcaaggggtataggctagcaattcttaaagtaatttatgtgagcatttggattgaacaaatgtgtataagtaaaatatataatagatcatagatcatgagagccagatttctcactgttgggaaaagtaataaataatgaagggagaaatctatgcagacccagtggagttgaactcatatttttttaaacattcatacatataggttgatacataaataaaattattaggagacttgagtgctttctgatgcccaacagcaaaggacaagcctgtggttactttattcaaattgattcaaaagcctgaaagactttcagcaaagtagataagaaatgtctgggaaacctaggtggtcttaatattaggaaagataacagaatttgtgttgtcaccatatttagttctgtcagcgtatctctttggtttttgtattgaggtataatatgcatatagtaaagtgcatgaacattcatcaaatgtttgtgaacgttttagttatgcacttacctgtgtaataatcctccaccaatcaagatgcagaatatttccaccaacccagaaattatttcattcctcttttcaatcaatacccacctctagagataaccactattttgatttctattgccttagattagttttgctttctcttgaatttcatattaatgaaatcatgcattacattttatatgtttcttatgttgaatactgttccattgtatgaatatgtcatcttgtttatctacttctctggtaatagaaatttgtgttgtttccagtttggggctatgatgaatacaactgctataaatgttcttatgtaagtctttttgtggacatgtgaaattgttgaaccttcttatataacttttattgttgtagtagaatctctgggtcataggacaggcgtatctttaaccttattagaaacttccaaggcatttttgaggttatatcattatggaaaggagtttcaattctccataaccttgctagtacttaatattgttgacatgtatttttaaactttttaattttgagattattataaattcacatatattttaaaaaattaagacagatcatatgtatcctttactcagtttactccagtggtgtaaaactatagtacaatatcacaaccaggatattgacgttgactcagtcaaggcacagaacatttctatcaccgcgaggatgctttctattgtccttttgtagccatattcatttcctctctgctcccatcccctccttcatccctaggaactattaatctgtccttcatttgtataattttgtaattccatatatgttatataaatgacctttggggattgactttttaaactcagcataccgctgtattttgtgtcttgccaaactcgagaagtttttggcttttacttctttgatactttttcagccctgccccttttcctttttagtgctctgatgaaaggaatgttagatattttgttatagtcctgcaattccctgaggcttggttcatttttttaatcattctattttccctttgttattcagattgagtaatttcttctgttctaccttccagttcactaataattttctctgtccactccattttgctattgagcccatctggtggactttctatttcagctacatttttaagttctaaaatttccattttatatcttggttcttttttatgtatcttacttctttgctgagatttctatttccacctgaagctttctgtttctttatttgtttccagcatgtctgtagttgcccttcgaaacattttcatcatggctgctttaatatctttgtcaggtaattttaccatcgctttcatctcagggttggcatctattgatcgtctctttaaaattctgtttgagatcttcttggttctgagtatattgagtgattttttttattgaaatctgaacatttgagtattgtgtttgaaactctggatcttatttaaaatttttgtttttcctccttttctctgatgccactccagcaggggaaggggaacaccgccttactacctggtagagatagaatccagggtccccattcagcctcattgacatcagagggcagggaggatcgtcaaactgccaggtgggggttggacttctgggtccctatgtacagatgagtcttgaaaaacatgagggtttggggcaccaacccccaagcattcaaaaatttgtatacaacttttggctcccccaaaacttaactactgataacctactgttgactagaagccttactgataacataaaaaatcaattaacacatattttatatgttatatgtactatataccacattcttacaataaagtaaactagagaaaagtaaatgattttaagagaatcataagaaagaaaaaaatatgtttacagtaccatactgtatatagcagttctgtaagtttatgtagtctgttcacaagatgaatcatctgtctgaaattgcaggcaactccaattgcagctgcagcttaatatcaagcaataaagttttttcttgtaaggtcatgacttttctctgcttcttgggcgcacttccagcatcactagtggaattttgtatggattccatggtgttattcaaggtttacactattgcactaaacacagcaaaaagtatgggagatcggtgagagatgactttttactgcaatgcgcaaatggctagagagatgaactgctcatgtggagagaattagcattgcattttaagtaggtattcacaaacttgagctcactgcaacagcaacagaaggtggctacaaaattattacagtagtatagtatgtactatagttaattttatgcagttgtgatttaatactgcatctttaagtttgtttgcatttctctggactccaagtgccgccacatacactctgtgtttatgtgcttaagttttgatacatttaaaatttttataataaatttgtgtatgttttatggtagtaagtgataaaatagactagtatttacatgcattttacacattcatgacatatctttttcttaattttattgatatttttagactacgttgtgtgtttgcaagtttttttcaactttttgcaaatctccaaaaatttttccaatatatttattgaaaaaaagttcgcatataggtggacccatacaggtcaaacttgttcaagggtcaactgtagtctccactgtaatttatttttctttctttatggttagggttttttgtgcacttttaaagatattgctgtccacttctaatataatacagttgttctcctgtgtcttcttttaaaactttatagcttcacccttcacatttagatgtctgacccatctggaatgtgtgtgtgtgtgtgtgtctgtgtctgtgtgtgtgtgtgtctgtgtgtgtctgtgtgtgtgtgtttatatatgattaaacaattactttggcatctatattgaaaagaccatttcttccccactgaactgcattggcacctttggagaaaatcaagtgattacatatgtgttcatctatttctgggcatgattctgttaaatcatctttttaacaattctcataccaatagaccattttctcttaattattgaagtttcacataagtcttgaaatctggaaatgcaattcctccaactatcccccacctttttcttcaagattgtctagcttgctataggatttaaatttccatagaaattgcaaaacagattctcaaacttctaccacaacaaatttctagtaatttgattcaaatttgctgagtttatgatcaggttgagaaaattgataatttaaatatggattccttagatttataaatatagctcttcatttatttaggtcctctctaattccttttattaatgttttataattttcattttaatgaactttcatatccttaattaaattcattcatttatttcattgtaaatggcatttttattttattttccaattgtttttagctagaatctagaaatacaatggaattttttattcaatgactgtgcaattcatccattagttctagtagtttctttacagatccttttaaatttttttatattcaaattatgttatctatgcagaagaagaattttacttattcctttcccaaatgtatgcattttattttctttcctgacttgatgccagttattccaatgcgataataaatggaagtgtgataatgtatcttgttcctaacctcagagaaaaaatgtttagtattttaccattaattacaatgttagccttggatatttttatagataccttttatcagattaaggactcttttctacatttctagattgttgagagtattcatcatgtgagggtattggccttgtatcaaattctcttgtgtgtgtaagttttgataaatttaaacttttaataatagatttgtatatattttatggtggtaaatcataaagaagttaaaataagttgaactcattattttggtttttcatcaagcaaaggaggagaaaaccttacccattatgatcttagagatcatgtaatcttctaaaatgtaagatactctgcgaatactcagtagattggacaaatacattttttattctttagagctatgcaaaatacttaatggtttttcaataccattaaaaaatcacctgttagtggcctcaattgtcttccaaaaaataaaggcgaacaaaccaaaagcaaaaaaggaaattgcattaattacttttcttctgcctttgttaatgtaacaacatgatatagtcctccctactttcagtaattgcttgtttcttcttatattttcggcagtactgtcctgttaacttacatctttgtgatctggtacagagtaggctcttagtgaatattttttaaatgaatggaatattattactatgacttttactctatatctttgtagcttgatttttcacacccgtgttggggaaatttattgtctatcattgaatttttgcctacaaatctgaccctgtgtttaccccattgtagtcttttgttcaaattctattccagaaaactgaaagagtgcacagacaataatttaaagatttgctcagcataagttctctcagtaaatttgtcagttatgactcatctacgcattcatgaaacaagtaattattgagtgcttattctgtgccaatatctcttttttttttttttttttgagacagagtcttgctctgtcgcccaggctggagtgcaatggcacaatctcagctcactgcaacctccgcctcccgggttcaagcaattctcctgcctcagcctcccaagtagctgggacaacaggcacttgccaccatgcccggctaattttttgtatttttagtagagacagggtttcaccgtgttagccaggatggtctcaatctcctgacctcatgatccgcccgcctcggcctcccaaagtgctgggattacaggcgtgagccaccatgcccggccgccaatatctcttataaacattgaatagtatgggcttttgaactagcctttaattatgggaatattagaaacaaaagaaaaattaactccaagtcagcaattgagaattataatgggaatattattgaaataacaaagtaatttaaaaaatagttaaaacctttcttggagtgttagaggactgataaaacaaagatgagtacagaggtattaaaactaagatacctaccttcaaacctgataaaagagtcagaagattgctggctgactttttgcctgattatagctacacagttcattcagtcagtcagtcacaagagggggctgcttcaccttaaaactcaggtttctttcttgcagaagggacgctaagcttatgttttccactaaagttccacagaaaacaggaaaaaaaatgatacacttttatcctctttagacaaattgtactttatgatctcttattaagtgtgttatggcttcaaaagttctggggcccttacactgatggactaagtcttttcagagcacctcccttaacactgctttctccaagtttcacttccctaatcatctcttacctcccctattccttacacctttttcttcctttcctttacctattcttaccaccgtcaccccaaacttctttgcttttcctggtctcttttctttccgcctcagtgtccttggtgcacacagtaggcataagcacgggcatagaaattaggaaatgaacatgaaggccatgagtttaaggaggatgagagccagcaccatttatgtcattagtcactatatcaagaacagatatattgagaaatggctacttagacaacagtcaacacatgattccagggacctctatagaaaacccgagtttggggagacttagctttcagtgtcaatgttatcaatttttattttccccctgagcacatcacttcctacttttgaacttcacttccgttttctagaatgtagatgggaatttccaactccttacaacacagagctcactataggcttctgggatttaatgacactttccacaagctccatggagcagaggaaactttatttggtacattgaggaagaaatgatggaagaaaaggtctggatagatacatccttatgatcagttttcctcattctgtgccagcctcttagactttaaacctcataaatgatttcagtagacaccccctgagttgaggatgtctggttgatatcctcaccgtcttctcaggaacatgactaaacctggggaggaagacatagaaaagcaactgctctatcattggctgacaagatcctgacaacaacacaatgagagctgcactccttgcaagtctttactagtagctgttgcttctgttctctggaaattctttaaacctagaatcagacacaaaaactgaactctgggtccacaatcctcatttgtccttgaagtatgaggctggtggcaagagtaactgtgtttctgacctttggtaagtgctctgtgtctacctagggagggcttctgaggacaagggaccccgaagggtggtttgccctctatgctccctgtgctttatccagcatactagatatgactgagaactgttctgtgcatttgtctaggaagtacatacatctacataccaggctagatcataaccataatcccagaagagcccttggcagtattcagttttaagaaatctatgggtttactaaatcaagctcccatggaatacagcctagagggtctctgattattggcatgtatctttggtctttataattaacagcaatgatattttttgtgttcttgcaggacataaaagttttggagtgttaagggagtgttgtatccttgatccatagaattgcattggtttgagagtcaggagctaatctgattttcttgaccccttaggaactataattgatgctaagaccacccagcccacctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtcgcacactgggacagatggggctgcacctgtgcaatatctccctggtggcaagtgaggaggagggtagcattcacctagagcaaaatgtcgataggagtcaaaaagtaacaagaaaagaggaaaaggaagggaaggagagaaggaggaaaataggtaaagtaaataagggagatacgatgaagggtaaaaagataagaataagaactttattgttgatgcggctgagaaaaatgataaagaggctgtgaatcataatttgaacatagcaataaaatgaagagggttaagaattttcaagactcttcttcatgtcaaaaaaaaatcatttcagtttgttagtaaaaatgaatggataaggaaaatcaaaataattctgcttgtcccaaaggcttttttcgtctggatccaggggcaagtccaagctttgaaatgcatgctgttatagttgttccaattaccagaaacaagttgatgtttctgcaagaaaaatctgaaatgttctttcttactagtgcagtaacatcagttactagagcatgcatatttgtgatgaaggtttttctttttggaaagaaacaaaaatcaaatgaatattaatttgtttttatttttcttgaagtcttgaatctttaaatagtcttcatcacgttttatttcctaagcagcacacaaatccatcttaccataaaagactcagataaagcaaaagtgaaagacctagctgcatttcctcattcttccctatctcacaacactcttttcaaagaacactagctttgacagtttaaggtataccatgatagccagtttaatttcagttatctatgtttgcatataactttatgcaatcacacacaaacttacatacatacacacagttttgtcatgtaaattggatttattagattttttaacttgccatttatttttcatttaataaattgtcctagagatctttctatatcaatagagaagttcactttattctttttggtgcttatttagtactttgagacattccatcatataattgcttttctcttgatgcatatttgttcctattgcctcactgtcataaagaacattgtgttctacatctttacagattcaccttagtttgtgtgtatgtggaagtgtttattttaatgagatttctgaaactgaaattactatgtcaaagggaagttgcatttaaaatttttggagaaagtggcaatttgccctccaaaggatgtaactacactccatataatacatatatatgtattattatacacataatgtatccattataactattatataattaataaatataatacatataatgtgttaaatagcttccaaccaacagtaggtgaaagaactcattttacatttttataaaaattgaattgagaattactaacggcttttatttttattttacttaattattctatttatttattttgagtctgggtctcactcttgtcacccaggctggagtgcagtggccggatctcggttcactgcaaccttcacctccaaaactcaagcaatcctcccacctcagcctcctgactagctgggactacaggtacacaccatcactcctggctactttttgtagagacaggatcttgccatgttgcccagtctggtctcaaactcctgagctcaagagatctgccagccttggcctctcagagtgctgggattataggtgtgagccaccgcacccagcccagtttttaataatccaaagatatattatctttagtcattttcctgattcatagtgtttttgagcaacttttttctacatgtattggcactttttcatttggcaatatgcttattcctaccttttgaatatttttctatttagttgtcctcttttctctttttattcgtaagaattagtttcatgccttaaataatacattatttgtatgaatattttattctaacattacctttttattgcttatttctaatataattttaaatttttacatattttaacctatcaagtattcctttcctttaggccttgaaggtcaatatctttacaggaaatccctaagtatatcacatattttaatatttattaccatttggttgagaattattttgagatgtatgttacagattagaaaactgagtctcaaagagatttaaaaacctgctaatattcacagtattaataagtgagcatcaagtttaaatttatttttaaacctgagattgtctaacactaaaatctgaacacacattgtttaacctcatcttactggaagcaatcataagaagaaaaccccaaaataatgaatcaaataaagcatcagtggaatggattatagtagccatctaagacacatgttagagcaaaaggtccggaatgttagggtagaaattgcgagttatgagttgagaaagtcaatggtccttaatcttatagaaaggtaatgttagtaccccaaacattcaaatagcagccaaaatgggtgttttgattgtggaagaactctaacgcatcctcagctctttattagccatatgtttcccaggcagaatggatattgaagaaattagaacataaagcaaaggaagtaggaaagaggagtttgatcctggatctgagtggcttccaattattctaggaaacttcacacagattgaggaatttttctggtccatagaatgggtagataaatgtaaattactatgatgatcatacttggaaattgctttgattccatgagtgaaagataagggaacagatatctacacacaaatcttagaaagtgcactgagatgtgctggtagcagtttccaaagattgacatatcactttcaacgtccttacagtcactttattcacactccttttctctttcacacagtctttaatctcatttaccttttgtttaacaccatcctctactctcctgtatttgaacacacaaatgtttgaggcctgtatttttggtttttattcactgaagcatcctctgtatctaggacagtgcctggcaaatagtaagtacttagaaaatatttactgaacaaatatatttatttataattgaaaatttttactggcaaatactaaggatgcaataaaatactagggacatgagttagattcgctatgaggatacatgagccattcagtgagaagcccgaactcatcaactttaaagaccattaatttgaatcccctttagccattaactcccatagccaccatctagacaggtcttatgataatgttctgctccacctctgaaatcttacctgcagtctaaaacctcccaccctgagattctcaccctcagttactctcactgtacttgttctttgactatatttggttatttagtcccttgacacctttcttttcttttttttttttttatttaacttttgttttaagttcaggggtattgaacttaaaataggtttgttatacaggtaaacttgtgtaggtttgttatataggtaattctgtgtcatgggggtttcttatacagattattttgtcatccaggcattaaacctagtacttatttgttatttttcctgatcctattcctgctcccaccctccaccctcaagtaggccccagtgtgtgtttttccctctttgtgtccatgagttctcatcacttcattcccacttataaaagagaatgtgcagtatttggttttctgttcctgtgttagtttgctgagaataatggcctccagttccacccatgttcctgtaaaggacataatctcatttctttttatggctgtgtaggattccatggtgtatatattaccacattttctttatccagtctttgatgggcatttaggtcgattccatgtctttgctattgtgcacagtgctgcactgaacatacacatccatgtgtctttatgatagaatgacttatattcctttgagtatatacccagaaatggtattgctgggtcaaatggtatttctgtttttcaatcttcaaggaattggcatactgtcttccacagtggttgaactaatttacattcccaccaacagtatataagtgttcctttttctctgcaacattgctagcatctgttgttttttgactttttactcatagccattctgactggtgtgagatggaatctctttgtggttttattttgcatttctctaacgatcagtgaagttgagctttttttcgtattattgttgactgcatgtataagacatacatgtaagacatacatgcagccaacaataataacttcttttgaaaagtgtctgttcgtgtcctttgctcactttttgttggggttttttcttcttgtaaatttgtttaagttccttatagatgctgaatattagacttttgtctgatgcatagttcgcaaacattttcttccattctgtaggttgtctgttcactctgtagatagtttcttttgctgtttagaagctgtttagtttaattagatcccatttgtcaatttttgcttttgttgcaattgcatttagtgtcttcgtcatgaaatttttgcccatttctatgtccagaatggtattgctaagttgtcttctaaggtttttatacttttgggttttacatttaagtctttaatccatcttgacttagtttttgtagacagtgtaaggaaggggtcccatttcaatcttctgatttgtctagtcagttatcccaacaccatttgttgaatagggaatcctttccccattgcttgtttttgtcagctttgtcaaagatcagatagttgtagatgggcagccttattcctgagttccctattctgttccattggtctatgtgtatatttttgtaccagtgccatgctgttttggttactgtagccttgtagtatagtttgaaggtggggcatatgatgcctccagctttgttcccctttattttcaccttatttctcagaagcttcttatcttttattttcttacctataatgcttatactctattacctgttgctttcaatctttagtcattgactatattattctcatcccaattctgcatcatagcagtgatctaattaattcccaatcatgaatctgtatcttccttattgtaatgcatatcttgtctgatcagagtacaccgatgcgcagattggtgtcattaaaacatactgttaccagccgggagcaggggctcatgcttgtaatcccagcactttgggaggccaaggtgggtggatcacttgaggccaggaatttgagaccagccaggccaacacagcaaaaccctgtctctactaaaaatacaaaaaaattagccgggcatggtggcacacatctgtaatcccagctattcgggaggctgaggcaggagaattgcttgaacctggaagacagaggttgcagtgagctgagatcatgccactgcactccagcctagacaacagagtgtgactctgtctcaaataaataaataaataaataaataaataaataaataaatgttgttaccttcaaaattaactaggcccacaatgtttccaggaaagtattcttctctgtaatcacatctcactgccattttctaaaacttctcacatacctcagacttcctaacccagatcctcctccattcactctcttgggagacatttaatctctgtgtataacaagaaaaaaaatcccattagaaggtaataggtgtttcactttctaccttcacactccaaagtatcacttaaatctaaactactgtaatccttttctccttcatttcaataaaattgaaaataactgtttttcctcctaccaaaactttgtccttctacccataatccacattccaatcccatctgtctcctcaaaactttgatccattgtttatacattctttccaaaagcatgtaaatataccctaatttgtataaaccctaccattacctcttcaacatcctcatccagttaacaccatgactcttttctcctctttagaggatccagcaacctctagaaggagatttctatattcaaattttttcttccttgtctcatcacaatgcctcttcccatagcagttgaccttttgctgaaaagaccaaaatcatgatttttgtgttgttaaaaaaatcagtagttcagtagcacagtatggtgactatagttatcaataatttattgtatatttcaaaatagctagatttggaatgttgtcaacacaaggaaataataaatgtttgaagcaatggttaactcaattaccatgatttgataattacatgttgtatgtatgtatcaaaatgtcacatgcatttcataaatatgtacaattattacgcatcaataaaaaatcaatagacattgaaaagttatcatcttatagacatttatttaccactcactctgttagccattcatttctttttagaattcctttttccttctcttttagaaatccagccatttctgatttgccacttacctctctggataccctttgaggtttccttttctttttcttttttttttttctgagatggagtctcactctgtcacccaggctggagtgcagtggcacgatattggctcactacaacctccgcctcccaggttcaagcgattctcatgtcccagcctcccaagtaactgggactacaggcacaagccaccatgcccagctaattatttgtatttttagtagagatgggatttcaccatgttgaccaggctggtcttgacttcctggcctcagatgatcttcccacctcagcctcccaaagggctggaattacaggcgtgagccaccacgcccagcttcaaggtttctttagtactttttccactatctatcccatcagtgtttgggttccttgaggatttttttaagtccctattctcttctaaattttgctctaagcatttgtcttggtaaaattgcatctagtcttatagggtagtactacgtcacagataacatagtgggcaaggaactgagcttgcagtggaaaagaattggattctaatccttgcatgtccttggacaaatgacttaacttcataaggacttgatttcccgtctgttcagtatagataagatctactgtaaagggctatagtgtaaaatgtgcaatagttatcagtggtcaataatgtggattattaaatcatattgatgagacaaactccaattctgttgagatagcagatcagccagacttgttttctgagcactggtcacaagaccctgctgaacaaaacaggagctgatcaaaacagaatgcagcaaagagagtggccaaaaccagctaaaaccaagatggagatgaaagtgacctctgattggccccactgctcattatacactaattataatacatttgcatgctaagtgaaactcccaccaccaccatgacagtttacaaatgccatgacaatccccagaagttaccttatatggcttaaaaggggaggaaccctcagtttagggttccttttccaggtaattcatgaatttatttattatttagaatataatcaaaaaatagccatatatatagctagccaacaatccacaagggctgtaactgctgctgctattactctgtctatggagcaaccactttcctgtactctgtagctccaatacacttgccttcactttgctctgtcagctcactcatgaattctttcctgtgtgaagccaggaaacctgctgggctggttttggggatcacctacctcactatcacttactatgacttggacaaattgaatcttttcttccatgctttagtttccccgtttataaaatgacgatgataatagtatttacttcataggattaaataatattatttactttataagattaaaatagcttcctcataagcagacccctgaaaacactgtcatcagattattctgctaagaaattcaaaccaaggaaatggagcccaaacccaaaagactcagtgtgtttccacatttgacctccagggggcaatgtctcacagaccggaaatgtctctgctaagaagagttctgtccttcctgagcggctttatctcacagctcactgaggtgcatattctgagtaggatcaacaccagagtggttgttgtcaagagagcagctcttactagtggtctctaggccttacctaagcagggaactcttgaatcccagattttcctcattatagggactcaccatcctctggcacattccttcccactcaggagatcttctagaatagagctctcagcttcctcactgcctagccatgctcttagtggtcattctgctgcttggaatgttcttcacactgagtaagtataataatattgtttccctgctcccgtctccatacaaggaacattgttccaatcggaatctaaatagagactctgtctcattacaggtagatctgttctggtctcactaacagagtgttgatgttgcaggaggaaccagaacccagtcggtgacccagcttgatggccacatcactgtctctgaagaagcccctctggaactgaagtgcaactattcctatagtggagttccttctctcttctggtatgtccaatactctagccaaagcctccagcttctcctcaaagacctaacaaaggccacccaggttaaaggcatcagaggttttgaggctgaatttaagaagagcgaaacctccttctacctgaggaaaccatcaacccatgtgagtgatgctgctgagtacttctgtgctgtgggtgacaggaggactgtgcctgggactgcaggaggagctgaacacaaacttcctgagacactgaggttttcaggaactcaagggcacagcctgacctatttgtagcaaggtctctcatttgatgaaagtgagaaaggtggaagaacagagccatgaggagtgcttgactccagagaagaaacagagacttcatcacgttccttcttttactactgggtcacatcagacaagatgtggaagagacagacttctatgactgttctccttctgcttggaaataccacactgaagagggtcaagtttttttttattatactttaagttttagggtacatgtgcaagattttaaattagtgtgaccagtactggactcctgatcctctccttctcactgccaacatgctgcttctattaccttttgtttttcaatcgacagcatctcattctttcagaatctgcccatagcctcagagttatttttgactcttattttttctttcactattcacattgaatccatcaagaaattcagttggccctaactaaaagatcgacccatagtttgaccactgctatctctttggtcaagccaccctcatctcaatgaattaccgtagtagccttccaaatggtttccctgcttgtcctcctacagaacattcttaatacagcagccaatgagatctttcaaatatagataggtcactcatctactccaatccttgcaatagcttcccatttctcttagagtaacatcaaagtacttacagtgacctagaggaatgcatgatgtatctctcgttacatttttaaaacaccaacagaaaaataactttggcaaccctgaattctataccagtaaaaatatcacaaagaaattatagtaaagacattctcgaaaggaaaactgagagaattcgttgtgagcagacctgctataaacgaagtcctaaaggaagttattcaggctgaagggaaaggataccagaggaaaatttgcaacttcaaatacgaaggaagaacaacagaaatagtaaatagatgataagatacaagaaactagtttccatttctcttttacagtcagctttactgaggtataagttatatacaaaaactatacatatttaatatatgcaatttgatgagtttggacatatgcatacaaccgtgaaaccatcatcacaatcaaggcaatagacatgtttgtcacctctaaaagtttccttgtgactctttgtttttgttgttattgctgctgctattgttgtaagaaaaattaacatgagatttaccctcaataaattttcaagtgctcaagcctgtattgttaactatggacactatgttgtatagcagatctttagaacttatttttacataactaaaactttaaaaccattgaacaacaactcccaatttctccctccccccagtccctggaaaccattattttattctctgcttctatgaatttgactattttagatacctcaaataagtgtaatcatgcattatttgttcatctgtgactgggttatttcacctagcataatctcctccaagttcaatcgtgttgtcacaaatggcaggatattcttctttttcaaggccgagtaatgtttaattgtatgaatataccacaatttatttatttatttgtcactaatctttcttttccatatcttgcatattgtaataccacatgcagaagaataaaattgaacaccatacgcaaaaacttactcaaaattaattaaagacttaaacatgatacctgaaagtgtgaaactactagatgaacacgtagagaaaaagcttcataatattggacatgacagtgatttattgggcatgacaccaaaagcacagacaacaaaagcaaaaaaagacccatgatattacatcaaactaaaaagcttctgtgcagcaatggagcaatttatggaaagggagaaatatttgcaaaccatatattgataagtggctaatatacaaaatatgcaaggaaccataaaactcagtaacaaaaaaaaacaagtttaaaatgggcaaaagactcaaatagacatttctcccaagaagacagacaaatagtgaacaagtatatgaaaaggtattcagtatcactaatcatcagggaaatgcaaatcaaaaccacaatgagatatcacctcacaaatgttaagatgaccattattttttaaaaagttaagtataggtgaggctgtggcaaaactgaaatccttgtacagtgtacagtgttcttgggaatgtaaaatggtgtagctgctatagaaaacattatggagttcctcaaaaaattttaaatagaactaccatataatccccaaaccctacctctgggtatatatccaagataattgaaatcaggatctcaaatagatatctgtattcccatgttaatttaagcattatacacaataatttctcttcttaatttatttaaaatgcatagactgttgaaataaaatgttataaaattccccgttggggttttcaaagtctaaagatggaaggcatctgagaactataacatgaagaaatgagggtaaagtaacctatatacaatttctatattgttcatgaagcagtataaataaatataaacagactgtgaaagattaagtagtaagcatagtagtagtaggcaatcctaatagaaaccactaaaaacataatacaaaaagaaatagtcaaaaatcaaatagatacattataacagaataataagagaccaaaacaaagggcagaagtggaaaatgaatactgaagtaatagacttaaatacaaccatattaatagttacattaaatgtaaatggtctaaacacagatatttaaagacagagattatcagtatggatttttttcttaaagaagacccatctacatatgaactgactttaaatacaatgacaaagattaaaagtaaaagaatggaaaaagagatccatgaaaacactaatcaaaagaaatctggaagggctatattaacatcagacaaatgggacttcagaaaaagaaatattaaagaaataaagtgaaatattacataattataaaagggttgcttcactaaaaaaatgtttaaagtgcttgtacctaccaacaaagcttcaaaatatttgaagctaaaatggttagaactaaaagaaaaatagacaaaaccgctattacacttggagacttaaaccctttgtgttcagtaaataatagaacaagtgttatagttagagaatcagcaaagatgcagcagacctgctcaacactattatattgacatttatggaacactccagtaaacaacagaaagaacataaagccatgcttagaagaaaatttataacagtaaacatttacattagaaaaagaaaaaaggctcaaatcaataattttatttcttccttctgtgtgtccccagtgatgatgtcctgcacagaaaaaaataatcctagcaatccaagaaactctgtttttgagttcaggcaaagaagagtattttctgctgttactgcaccaggtacccaactggaaaatgatatgtctcatattttatattgctctcctatgctcaaagattaaaatgagattaattctatttatatcacatgtcacagttctggaggaggttatgagccttcctattatagtaatgatatcagaaagggtacaagataagtttagtccttcatcttttaaaaaaatatatcagttatgaagattgttcgccacgaaatgaattccgttatatacattataaattatataggacattatagggtaccttacaatacatctgcgtattttcacacaaggtgagatatcactaattattaaatggaactatgccactatgtttttccttagcttttcaagggataagcacaagaatattcaagttatgcagtgggtcaagcctaagaacaaatgggaaagctgatagaataaagaaagactcaggctaggttctggactagctgggactaacatataataagtccataagtgcagaatgaactggatgtgaggagtgtgtaacccttctccatttcaacgtgcccaccttttgctttatttttcgctgaatgcctctcaatataacaatgtaacaacacactgacatctcatttaagtgtcagaagcattatggtacatgatagagggaacaatcagcttttctgtgtcctatttgatctttgacagtataaaaatctgacttttttcctgtgggcaggtatagagggcgtatatgataattttgtgtactttctgctcaatttttctgtaaacataaaactgctctaaaatagtctattaactttgaaaaatcaattttagtatagaagctaaaaagaaaaaagaaaaatcaatccaatgcgctcaatctcatagaaaatatttgctacaaccagttcggattatttcttactttcctgccttgtgtactctcttcaactttttgtgttggtgcttctttggtttgtgtatttactatgcagcatgcattatgtaaagttttgcatatattatataatttaagtatactaacatgaaagtagaaataacttctgttaggaaaagaaatataataagtaatttaaaagaaaaagtttatggattggatagggtgtgtagaactctcaactctgtcattatttgaattatagtagaaacgttaacaaacatcttaaatttcaattttatcatctgcttacaggagatcatcatgatcatcctgtcggcagttgttccaattatcgaataataaaatatctttcaagggcttagctcatattctagcacaatgtaaacatttaataaattattataggtaaagaaatggaggcccagaaaacataactaattttgctcataatcagaaacctagtgcattagagaaagaacactgagttttgaaatcctagctataaaatttaagccaaatatcttcaacttatgatatcactgatctattctcttgaatacatatattggaagtaaaagatgagcagctagagaaaagtagaggaaaagagagaaaccaggggaagcactttgaaaccaccaaacatgtattatctcttcagatattcaatcacacagataggcatactccttgatggccatttgtactagggctgcaggacttgataaaagagaacctacaacaacattctgtaaccttcaattgatttgttgccctagatctggtccgcatctctctacaaggttataaatgtaatgttgttttcagctgtttctccttgtattaatgaaatggaaaatcctttctcttctgtcctgacacagccctgattattaactggagtcacaatatttttctttctattgttatacaaactgtgtggaaagtattctctttattctcaagactatgatttaatccagttagtaagagggaagatcaagatagttagcttgatttttccattattcagtagatgggcctttatataaatgaagcgggagactggcagtttactcctatactgtgtgagcttcctttcattaagacctcggtgtcttacagcttctcatgactcttctctctcccactgtcaccttctatagcagcaggctctttcctggcagatcttaatgtgggaattaaaaaaggattgatgtgtccacatattaccacagacagattgatagggtcaggctagaaagaactatgtagaaaaactcggcgatagaagcaaaaggcagaatgggatgtacagctgagccagaaaatacaaggcaagaaaagataacagagatcgaatgcccataaatgtccttatttctgtgctagggctctgtgactgcaggtacaacagagaacacatgagatcctaaggaaagagtgtatgtacgggcgttggaggcctgtgagtaccatcagaacttcctgagtttcttccaaatgtcctttcttcagtaggtatatctctgaagcacctgtgtgttgaatgaagaattacctaaagggctgaatctttctcttcttaccttttctctagtcagtgccagactttagggcatgtgtcctctgggatcacagacctcattgaaaacaaatcccagtatcccagtatggcttccattctagtgggaatgggaaggcaggcccccgttgtgctcctctcctggggatgaatgttcactgaggttctgcagtacctctatgccatggctctcctttagtcctggaaacagcattcagactccagtccgtcatagcagtcactcaggatcttacagccagctcagcaacaaacaaaaacatagtctggggctcatagcatcccttccaaagactagattttctgatttcaggtacaagattcttgtgacaaatgacagaaacaatttgtcaattcttccgaacagaaggtccagcaacctgaacctcccagggtggaccagagagatgctgttgtatatgactatgctctgagagggatgagagtgacaaatgaggctgctaccgtgtgatagccctatgacaaaaatgaaaaggatggcagccttggaagccagttgaaggaaacatacataaaacacactagcaagaacagaatgcttactctttctttttgataagaaagcccatctgtcatatgcttccttggtctagggaccaggttacaataataatgatgataatgatattaaaatatatcatttaatatcattttcattagtaataaataaaaaagatcaagtaagtaagcacgaaattcaagtaattagaagaaagaaataaatctaaggaaatcatgaaaatggtacagataaatgtataagcataactaaattatgagaaaaaagaaaaaatagaattggacaattttttaaaaattgaatcatgaaaaaattagattaactcttcttttattgaagtaattattcaaaaaagagagaacctatgtaataggtattatacaggtgtatagatacatttatatatacattatatagttttctatcactttgttatcttaatttatgttttagtcctccgtgtgtttcttcttccttcacctgttttcaagcaggtggtgtctctgtgcttcaacatgtaagtgatgatgcctgggaatacagaaagctgtgtttgcctgtagagtcttctggcttgttttgaaaaatctaatttctttcaggaataatagggtttatggaagtgggagaggtggaaggaggttttttggtataaatagaagagagaatggcttttccaggagagaataaaggggtctgtgcgtcctgggcagcagggaacaggtcgttgtttcttgacaactctctgagaattagtaagacccaagagtgggatggctgtttgataattagaaagagttcccaggcttgcaaaagattttggggactccataaacctgaaaaacagaaatcttccacttagaatacacacctaacatgaatagttcataacatattggataagaaggctatgtttgtgattccactcacagaccatagtgataccatttatagttaaattggcttgtgagaacgattactaggcaaagaatagaacttgtcttggttgtctttataatcacatacacaggtctgtctctttgaagcattagatctcaacagttcttaagtttggatattgggctgggacagatgaagaagacctggggatccctcagttcagctctcatggcttcacattggatgtgagcacagaggctgtcaaagacttttcccaacaggctaagggatagggcaaacagtcacgctcattgtggattactcagaattccctatgagaaaggcataaaaaggttgtaaattcggtagtaatcctgaatttacaatcttatgcagttctgcccatcaacagggagcagacttcgtgatctctgcacgctaaagggggaaagaagatcaaagcttcttttcatgctttaacaggtattagcaaaattctgagaaggattgccaatatcctgttcataatgaatctaaactggagtgaaaaggaagaggtaagagctctccttactaataaggaggcagagcttcctccacccttcagtcttccagcctgaggctcagccacctacctctgtgtgctatgttcttttggcacctgcagcctgtccccagtggtgctgctgggcttatggctcccagtgtcaaggcagcaaacttattctcaacaggtgtatagggaaaggcaaactcagtgaatcaaatatttttaatattctgaaaaaatgatctggaaatacaaacatataacatttaataaatattatttataaatcatatgaaccattatcaacttctcttcctctgcctcagccatgtcagtaactcagttattctctcttatgtcttggcattatatgatactcgagattattcaagtgtatgcattggcctatagtagttgcttttctgtttctatcccctaaatattggttatattatcttattttttgctcctacatgaatgggacctacaatataagcagtccccacttacacacacacttgtgcttaaatctcaataatctcctactagtgaatgcagtgcaggtctctttaatttatggttacttttttccagtttcttccatttcaacaatgtgcacattttggtttttgtgccacctcacaatttttctttcctgactctttgtttccttgagaggatcaggcaagaggaaactgacttctctcatctatccatacccactctgtgatcttagataggcttcttcctctatcatatggagacaattttacctactctacctcttacaggattattctgaattatcttccaaaatgaagatttctttgcatcaaataatatagaactaggaaagaattatatatatgatgagatgagcctcattgtatgggtgaagtaaaatgtggactatttctgaaatggattgtatattaaattgcaatctggttagaggtttaaatcactaaagaggtagttattcatataaaactgacttagagttgctttgataaattaatcaggaacacagaccagttaattaatttatagcacctgttaacatccaaagaaattaaacctttcttctcaaaattaagctctaaccgtttacactatagtcattttaagtattttaggattatgggccaggcgcggtggctcacatctataatcccaacactttgggaggctgaggcaggtggatcacctgaggtcaggagttcgagaccggcctggccaacatggcaaaaccctgtctctactaaaaaatacaaaaattagccaggcatggcagtgggcacctgtaatcccagctactcaggaggctgaggcaggagaatcgcttgaacctgggaggcggaggttgtagtgagctgagattgtgtcactgcactccagcctgggcaacaaagcaagagcccatctcaaaaaaaaaagaaaaaaagaaagaattttaggattatgtaaagctactaattggcttacagaaactgactaaaataggaggtcttttccttggaaggaaaagatgtaataatctcagttttggataaaattgggtagaacagatttccctacggtggttaaagggataaaaacacaagatatccccagcatctacattacagacttcaatgaaggaagtaaaaatatctcaatagttgagttgaggaagtgggtcaaggatatgaatatccacagatgctgacaagggaaatatatgttatattcataaaattcaagtaattaagataggtaagtatacatgtccacttaggttagatgttaattcttaataagtaacataatgatctgaggctctttgtgtgccacttctacatctcaaactttgacgtggatcccctggagatcttgttaaagtacagattatgattcagtagggtctgaaattctgcatttctaataagctccaaggtcatattgaagccgctattctgctgagcaaggtttccactatctgagaggcagtattccacaggacctaagtgggtccactctttagccacactgcctagattagaagactggctctgcccgcttactaactatatgactatgggaagattaatgaacttctctgtgtctcagtttcttcatttgaaaaatgagaataatgttaacttcctccagtgatgttgtgaagaataaatgtgttgatttatatgaagtgtttagaaaagtcaacaacattgttaattgtacatattgtttgtcaagcttgccatatcaaaaatatctatgtgtttttgactactaaatacctatgtgtttttgattggtatttaattggctacttgtgtactagttgtttaaaaagggacaaggtgactaattattgagttttatgtagttgttacacttcttcacataacgcttgtcacagaacaatatagtcatatattctgggcatttttcactcaggatgagtgtggctgatgaggctgatgtattcttggatttttctaggtgatgattcatctgggctgggcctttcattagggcctgttgagaaagaattgaagtagtaaagctgagcttcagggaatcctctaaatagattggttgaaacacagtctggtttatatacataatctcaatgaagcctcaacacatccttgtggcataagtaatataagccccattcaacttattagaaaactattacaggcgtgggttaagtaaattgtttgatgtgacctagccagtaaatggcaatgatggagtattaatataagtatgtctgaatccagtatcaagtcatttaggcagaattcatcacttctctacgaaaagtgttaagtgttaaaaatatttctgaaagttttctcttgtatccaaacatttttatattcagtattctatttgtcctggtgatcctgagctcccttgaggacattggtggcactaaggggaggcttacacagaactggtgccttgaactcagtttcccctcaccacccttatcacactggaggctacccagggtggactcagagtggaaggagaattgtccatgtggaccacaggctctcaccgtggaatgattctggaggacttgatagtgtggctagaggttctattttaagctctgagaaatgtggaaaatctcctggggaggtcaacagttgaccctggccctttcctctctggtgcaacctccaaagggctattctatttctctcgcttgtcactgagctctacttcatgtgtaaaggcaggttggatagtttccaaatctttgttgggatgcccctctaaaccttggataaagtctttccctgtggccccattgttagcagttattacatgtccaatgtttgcctgtaatgctgctacaggtcttttttgacacattagttttgaaaattgtttttgacagcagctcttttggacactaaggacctggaaggcagagaccttatcttgtctcatttatatcccccaaatctagtacatggcctgaaactgtgtttattaaatgaagaatgtgttggaaaattagattctggagaaaggcttgcttagaatattttaatcagaaatgaactttgtactttttcgcctatactcctacggagccacattttttctaattatataccaagaggaataatggtacagtttgagtgtgagtgtttttattttcttttttatatattgataacaaactttttttataatgggcatatttggggtagaatattttctttttaatatattgataaactttttttataatgggcacatttgggatagaatatacttctatcccaaatgaacatgaaacaagcaaaacatttcttcaataactgaccaaagatgatagggattccacttcaccttagaatatgaatagctaaatagtgtgacttaattgtgtcatatattatgaataacagagttcatgagaaaatgagctatattttcatatatttgacggagcagaatatggcagtgaaagagcaaaatctctttcatctggatattcatcatcccaaaccaaatcttcattaaacttgggtgctagagctactaggaaagctcttgggagtcttctttgagactttgcggtgtggcttctgatgaactgttaatttggagacttgcataaatgtaaataaagtggcattaggacagtcctcaaaagccaaaagatggaagagtgcaaccaaacctggctcatttgcaattgcagtgatgccttgtggaaataaaattaatatctggggtacagtggctttaaagcaagatcctagatcactctaaatagctgtgaatcaggaaaaaaaaaaagtttccggttgctggatattctagatcttcatttctagattccaattatttaagagaccacagagcctttgtcaccaggacagagtcatttgctctgataaaggggaacaagatcttacaaagaacgttgttgatgtgaacaactagtttactgaagacaagtccttcaacacaaaaagaaacaagaaaaagagaagggacaagcaaattgttatcgttcagtcactccttttcaatccacttgttactatcctgatccaggttctcattatttctcacctggctaattggaatagcttcttaagtatatcctctaccacttagttcatgcctctccaatctgttaccacctctggagttgtcctgctaaaacacatgtgtaactagattactaacctatttcaggaccttccacagctcttcattacccaaaagtaaaactcaaggtttatttggccatctacaccactactccccgtaactttttatcctcattcctatcattacctccatgatctctgaacttcagcccatcagatgacctcactctaacacctccttcttttatatgttatttcttcataaacttggcaaaactctacgcaatcataaaggcccagtaaacatgatacctttaaaaaaaagatttttccaagaggtgcctctacttcattatatccttcaggccaattcatgactatatttccttttcttatacccagtagttcttacttagaatagaaccccaggaggaagatatgactccagccacactgttctgaattccatcctttttataaggatgaaatccagaacagaaaaattctgtggcagaatttttcttctgactgaaactgcaaggagattcaagcactaaaaaagatcattccatattcccaatcagtataatgacaacgatagttaatcccagtgtcaaggaaattttcttctcatttccatcttgaagctaaatcgttattctacttttcagataaaagcatattatatctaaagggctcgggttatgggattcctcaaagaagcagtcaatagcttgtaatccttgagcagctcttttcttgttcccatgagccccacaggctgaccccctctattttaagcccctcaaggaatctggattcccacatacccacttacaggtaaaatttttaaaaagaaaatgcatatgcattgtattttcccatttaagatattaacaaatagtcatatggccaatctgactatctttactaatgactgtatgcaatggctgaaacaatcctctcggtacacaagattttgtgatatttgaatacatactatactcacaccacaacatctatatccttaaatcactataccaatgcacaaacagtttacatatcaattcatgattatgtgttcacatctttctgtctagtaactgctggggttacaagagtgaaaaaaaaagcacaaccttttccacaaggaacttgtagatgagcccaacaagtgcaattaccagatagtgtgatgagggctttgataagcatgaaccagggatctaataacagagtaatgcagtagaatatcaaaaaagtattctaaattaaataatctacaacagaattgttcatctttaatttagtaaaaataggtttatgacactcatgctctatggccctgtaaatgtagcatcatttcacaccacatatgccccctactacagttacagttactcagatactacatggctcagcacgcttgttgaggatatcagaaatgataagatggtactttcattattttctattattcttttattctggcttttaaatgatcaatgtttaaaaggatatattttccattttttttaataaggtcacaatactctttctgtaaccggaccccagtccagctgctctccacttgaaagccaaacagagagccgagggtagatgggaaaagcaggtttaatatgagagccagcaaactgagaagatggcaaactagcattctaaagtaccattttacatttttaaattcaccatgagattttaaaaatgaaacataggatgggagacatgcaggaattctgcagggtgcagggtttgtgtgtcttgttctcgaggctgtattgggtaattgcgcctctgggggtctggaagttgttatcttgacttcggcctggtggtggtggacaaattgttcacaagtccccctaagcttgatgatgcctcaatggggactgcgtggtttgtttctaggtttgactctgggatttcttaagcaagagaataattagacaagcatgcattactggcaaggagtgtccagaggggaagaaatgaagggatgagaggggagggaagggaaggaagaaaaagaaagtgggtgaggtccccagttacatttctactttaatcttgatatttatgcctaccaaatgcaattgggagaaacagagcattattggaaataaatcacttttctatctctccacaggagggtagtatttcaaaaggcaacatacattttgggttggaggaaggggcgggtggagagtgaatgattccattggctgccacactgaggctcctggctttctatggaactcaaagtgggtggcagcaagcactcttctagcccagagaagtctgttccaggacgggctctttcaggagcagctaaagtcaggggccatgtccaccatgtgatagaaagacaagatggtcctgaaattctccgtgtccattctttggattcagttggcatgtgagttgaaaaggttcccaattaaattaacagaaaatccctgatggcaagttgttttatggcaaagtatgaaaggaggaattataaaagaaggaagaaagggggaaagcaagggagggaggagaaaggagtaaggagggaggaaaaatcatttcaggttgggaaacaatccctaattcccttccctggttccttctgctctgtttctaaacaggggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagactggtgatacaggcctctacctctgtgcaggagcacagtgctcttgaggcacctgctgcctgcacccaaaccctgctgccagccccagtcacgaggctgccacatgcctccagctccgcctcgcacagcttatggcatgaatagagagaacaacctcagcccctcatggaaccatttctgctgcctttccagaaaacattttccacacacactggaggacaagacccctctgctataacacaaatatctggaaatgcagcctgctattaggatcattaacgatatgggcctgcaactccccggggtaggcagtagcaaagagagtcgatatagagggacaaatggaagctatcagacagactgtttctgagtgttccacccctgtgtagaaacaaagcagaaggcaccagggaagggagctagggattctttcccaacctgaaatgagtttttctccctccttccacctttctcaccccctcattctctctttcttccttctttcattaattcttcctttcatagttggcatcagggattttccatctctttaggattttctgttaatttaaatgggaacgccttcagctctcatgctaattgaatccaaaggatcaacatggagaatttcagaatacttcatggttcagattggtcattccgttttccagaagaccacacccaggaatgttcagtacaatggggcagaaatggatggtttcccagctttcttgtagtactccagagatgatgaagctgctatctttccagactcttacactgcagtaaaatgcagaagtattgtaaaaattagaagaaagttactacctttttggaagaaagataccgatagtacacctcagtagcatccaactgtggtttcaaagcaacatcctagttggtggttctgaaagtgaccaaacattaactacaatggcctgtatgttcacaggactggcttggggaagagtctttgaatggcaaatgtcaataacttcaagttttcaagcctgaagaagaaagaagttggcagtttcctccacatagcaagccctccactggcccattttcatacttgaagcagttgtatttgttctgtaaggcaagatgatatagcaaaatgcacatgagtttctgagttttgaaatcaaaataacttaaattaaaatctcgtttttgcaattttctagctctgtgtccctgggcaattatttatcctcacctacatttccttataaattaatgttagtaagaacacctatcttgctgagttgctatgaattaaatgagataaaatacataaaattgtctcaagttccaggcataacatgtatactcaacaaatgtccttaaaataatattgttattgatggccgtatgtaaatgtcacccctactgtggaattttcactgactacttaagggggaatgagttattctctgcctaatactctgagtcctcaccagaggagtcaggaaggcagacactgcaagctgccaacctaatcacaattcttttctgcctccttattaacaataccctcaattttgatttgggcaacaatatgtccagctttaaaaaagctcaacactacattttaccctctcttgcagcaagagattgccatatacatatagaacagttctgaccagtgagataggaccagaagttggatagggccttcccataatgtttttttctctcctgatacaagtacacatctctctatccctccttttctctttttaaaacatggaagagataactttaccgtaaaggaaaacacataactaatcccctttccttatcccatgcctggtagtcttttagatgccaagtcaaatccagcccccagatttaattttgcatgaaaatttttaataaaccattatttggttgagttttctgttgctgcagctaaacataattctaactatagtaagattgacataaaatggctttatgatttcttgtttccatgtgtaaaggcaggaaaagatatataaacaaattactttgtttatacaaacatggggactccatttatgttgatcatatctgtttcataaagtattaatattcctatattttttataaaggaaaaaaacttcacctttcatttagagaggactcgttattaaatttccatagcaatttcttatactcatggaagattatggaatccagatttcatcctaaagtcttttaaccacagacaatttccatgcaaataataactatagtcttacatttgtcttaactttatattccaaaggttatttttcttattttcttaaccttactctacccagtaatccattttaaaagcctcctctaaaaactttatcacattaaactccttcattctgaaaattttaaaggcaaatacaaataaaaataagaaaacaattttaattatctctgatgcaaaaagagaaagacactctcccctccctttcgttagagcacctactttagaaaacttgtaattgtgagttttctatccctttgaaatgtaggtaaatctttttaaaagctaaataaatcccttgccagttttacaatccaggactgtctttctcaagaacctgagagcatttttttcaaaatgtaatcacgaagggaggtagtgccctaatctagttttagtggagaataggtgcctaacttcagctggtactttgctcccagttgcaaaccaacctcctgtcataaagatatgagaaatgtttcctttgcatgaaggcaattacgaaacaggtggctacctcaattaccaggtaaattgaggatgaactatgtttgaaaaatgatgctgtcaagtcctctttcttgcggactagttattgtttatcttgagaaactgtaaacaatcagttgcatctgctcggctatataaaaggataagatttctttatttccttgtagtatctttagtggattgcctgtgagatgcatcacattctggtttaatgcttattcaataaaactgtttttttttttttttttttgagacagagtctcactctgtcacccagactggaatgcagtggcataatcagggctcattacaacctgtgcctcccaggctcaagcaatcctcctgtttcagcttcccaagtagctgggaccacaggtgcatgccatcatgctcagctaatttttttgtatttttatatagatggggcttcaccatgttgcccaggctggtctctaactcctgagctcaacctatctgtctgccttggccccccaaagtcctgggattacagacgtgagccactacacctggccaaaactgttttctttctcttctacctttgtgggaaggtgttatgggttgataggagattctgttttacttcctcaacaaaatggcccagggtctttccctaatcactgggcttacatgtctcttcctgaaaagcaccatgacactatgaaaagagcaagggtttctaaaggctctgtcccttattggctgtgtaaatttgggaatattatattaacttcatgagcatcaatttcctgataagtactgcagaagtaagaataaatacttaatttacagtattattgtgaagattagcaatgttttggtaactgcctagcataatggacttacaaattaaaaaattgaaagtgggaaccacggcttccacaaggtacactcaaaacctcatttgtgtcctgatatatgttttgagccaggaatatgtgtaagagttaaagaaagaggaaagaaacacaaaacacagcttggcagttaaagacaggtttactttagataaaacatgagaggggcttctggctgatttatttatttatttatttatttattttatttttatttttattttttggtcaggagcactttctcttgcagactaagagtatatattggttttagggtgagggggtttatcacaatcttggaatgtttatgtgtggaggagaagtttatggcggggtttggaatctctctgggaggaggggaggttatcttgaggctgatgtctttttggcaggagggggattatcttggggctggcaccttcccagtcagagcagggttatctcagagctagcatgcctctggttggggaggagtttggaatgtttctggttggagatgttatttgtggtttatggtcatgctgaccatagccattaggctgatggcctttggacttaggaagtttttgattaaggtgaatgttaaaatgagggcttgtccaagacagcgatgctcctgctttgtcaatatggaaaggacacagtccctgcttccaaggaactcactctcatggtgatagacagtcatagacttgctcccatagccatcattctccaggggctataagttgaagaatcctctgacctacaacctccattcagagcagtaatttctgagagaaattgcacactctccacactcctgaatcactgtatgccttcctaaaaacacactgctgatgtttaagaccagactcaggcaccacccctgggtggggcatctgcattgctgcagaggaagtggtgttagctctagggggtactctaacctgagaaaagtctccttaggctgtcaggaggattgatggatgaatggagaataaaaatctctgaaacaggaagaaggctaataatttaggctgagggtgggggatcagtagcaaaagagtatatggaccataaaattcttaataacatacataatcctgctttcttatcaccaattctcctttatctccaagagccaagatgaagcttaagatttaaagaagacaatttgtttaacatttatttatagttcatgaattaatattttttagtatcaggggccaatatgagactagatctgtttgtccagaaattatttctaatctctgatcactgttcttatctaaaccatgcctatggacatagagggtagaaggatgattaccataaactgggaagggtagtgggaggctggggaacaggtgggactgtttaacaggtacaaaaaataggacgaataagacctactatttgatagcacaacagggtgactatagtcaataataatcgtacattttaaaataaagaatataagtggattgtttgtaactcaaaggataaatgcttgaggggatgaacaccccattctccatatgtgcttatttcacatagctttcctgtaacaaaacatctcatgtactccataaatatatgcacatacttaagtactcacaaaaattaaaaattgaagaaactcaaagccaagaaaaatttttaaaaagaagcaaattgagaaaatgtaaggtgtagctgggaagaaaaggatagagaaaggttaagaagaaaattatggaggactgtctgaattgaaaagcattgtctctgtgagtttgtcaacagcaacattactagcattttgggccgggtaattcttttgggggaaggggcttttctgggcactgtagggtgtttaacagcatccctcatctctgcctactagatgccagtaagattctcacctgtggcaaacacaaatgtctccagacactgtcaaatgtccctggaggcaaatagcccctggttgaaaaccaatggtctatatgtctacatattgaatgttgaattgatagagcaggaaaaacttttagaaggtatatatatgtgtatatatatatttagtatatatatgtatatatatttattatatatgtatatatttattatatatgtgtatatatatttattatatatgtgtatatatatttattatatatgtgtatatatatttattatatatgtgtatatatatttttattacttatatattcatatacacaaaatgaggatgttaacatttttctactattataacacatttttattcctatggtggtcatacgtcctaagttgctattatttcatttggctttaataaattaaataagataatttcaatgtaaaaacgggaattgtaatatatatatataaacatatgtattttatatataaatatatataactttttatacaattcattcacaatgcaaaaaatttttcagtctgatcacgttccagatttcaccttggtcaatatcttttatctctgactcctcaaagacatatagactgtttctctattctttctctaagctactgtgttcctgttcttccccaaaatgattcttaaaccctaaaaagatgacccctccattaccccccacccacacacaaacacacacaaggactcacgcatacgcaccacagtgtgcagaaggtgaactaaaccacaggtaggtggagttttccactaggaagctgaggggcaactcccgggagctgctgccgctgaatctgtctcatgaaatttctcagccatgggaacaaaattagttccaaattcaagatatgatacttaccaatatttaaagagaatagatatcaaggtgtgcccctgtagcaaaaaaagtaaagaatcatgaaggcattaataggaatcttgctgggcttcctgtggatacagatttgctgtgagttaaggacagcccagaggaaacctggaggagtatcacaactgaatttggaaaggagcaatggaggaacgggagagatggagaaagagaaagaacgcaactctcaattaagctgtgtcctctatcataaggaagaaaactacagagaaattttctacacttggaaacagctacagtgattttgtgatgactctcatctgcatctacttttctctttctgaacgggggtaaaagcgcaaatgaaagtggagcagagtcctcacgtcctgatcctccaagagggaagaaattcattcctggtgtgcagttgttctatttacatgatccgtgtgcagtggtttcatcaaaagcctggaggacccctcatgtccttatttaacattaattcaggaatacagcaaaaaagaagactaaaatccgcagtcaaagctgaggaactttatggccacctatacatcagattcccagcctgaggactcagctatttacttctgtgctgtggggacactgtgctcttcagacacctgcagcctatacatgaaaccatagctgaaggcctaacccatccccgagagtggcagtaggtcccgatgtgattagcattgcattcccactgcctacatctccttgcatgtcctgattcatgtggaaagtatttctaaatgagttgtaacttgacactatggtgcaggtgcataaatggttcccctgcagatatctgtgggaatggtattactaggcaaaatctattgattgatcaactctttcatatattatcatatctctctggataagaatgagcagagtcctcaatcctccatatccaagagcaagaaagcaccagtctcacctgtacttccttttccacatcttttttatggcttactttagtacagacagaatcctaggaaattttccatgatattttttctaacagacttaagtgaagatgaaaaggaagagggaaaatagatggcctctactaccatgaaggatggtcagagctttctgcatacttgaccagagactcagccacttacctctatgctgtggagacacagtgcttcccaggcacctgaagcctgaaatcagacaagtacctgcaattctaagactcaacaataagttagagatgtccatgtgttttgctgtaacatggttttgagaagcatacacttgataaatcaaagtgatttcatttccaaaaaagattctgatgaatacttactctagtaactatctctgtgctaaacagaacaattcctaacatcctaatccctaaatcagggaatcaatgagtcagaaattctagataaaggatccctcaaactcaatgataaggctttctgtcaaaaagggtatttgcaccccgaatgctacttattcttatcttacattatctatgtataaaggaaaatcttgagaaagtcaaaccaaaatgtgtcaaaaaagacatgctaagctctctaatccttcattatttttttttccaacttcttttttttttttgagtcggagtttcactcttgtcacccaggctggagtgcaatggctcaatctcggctcaccacaacctccacctcccaggttcaagcgattgtcctgcctcagtctcccgagtagctgagattacaggtatgcgccatcatgcccagctaatttcttgtatttttagtagagacagggtttctccatgttggtcaggcttgtctcgaactcccaacctcaggtgatctgcccacctcggcctcccaaagtgctggcattacaggcgtgagccaccacacccggtctccaacttcttaaagtatttttaattgttcattttgctcatattcaatagtatctatatcattttcctctttgttatgttttgtgaaggttattagaaaaaagcttatttccagtcatgagtatgctatgtcatcttcagcaagtgagtcattttatttgtccctcatctcagaatcctcatttataatgtgaagatgatatttcccacccaccactactcacaagtttgatacattaattattcaacaaataattatcaaatacctattaggttctgtagggaactttgaataaataaagagttctttccttgttgaatatatttctagtggggaacacatttttattatcagttcctataaaatagagaaggacttaactggcacagtaaagggtattataaaaacaaacagatgtctgttaaaggaagctttctggagtatgtggtgcctcagttcaaaatctggcaatttaataggagttaatcagactgaagaacaaaagcaagtgggggaaggttctccaatttgaggaacagcatacatatataggcaggaagcaaggcagattatagcaattttaagacataatgtataatttgcaagttattaaataatgttcataagtaactcttattttatgggagactaaataagaaccttgaaatgaatcgtctgtaaatcataatatggtaaggtgaaggatatggggaacaaaattactaagcatatctacatcctaacagagcagataaagataactgcactaagaacaaataaaaataatcatgcaactgattgatgataagaaaatgttagttcttcagagaccctaatcccttttaagtgtggaaagtatttctaaataagttgtataagatatgataaatatgatacataaatgtgatccattttgactattaaataaagctgaaatttccaatttgataaaagtctccactgattcaaggtactcagcaaactctaaacagggtaaatgtaaagcacatgcacacacacacacataaacacacacagaacaagagaaatgcatacttctacacatcagagtaaaactgctgaaaatcaaggaaaaagagaaaaatccttaaaatcagctttgcttttgtttttcaaagggtcaatttcatttccctcaagtttttctgaaatcatggatgagtgagtctagcaaatgcccagccctcttcaggagccgggaaacatatgtggcccagttgcaaatttggggacagcttatggaggcctgaagatcactgcatttgatccacataggtagacacctgagcagctgggctggccaaaactaatttgacattatagtataggcaagagaatggcatggactcctcattccagtcaaccaaaagcaaagaagaggtgttattctactggctgagatgattgatgctgcctttcatggagaaatggtttgctacaatacagtgggggtaaagaagagtatgtctgtggaaactcttaatcccaccatgaatgatgataaaatttaatggaaaactacagcaactcaatataggcaggactgctaagacatagatcttgaggttatcatcccaccagacaaagaaatatgattgctgagggcaaaaaacaataatgaatgatggcagaagaatgaaattgtgcatactagctacaacctcttgaccagtgacagaaacaagatctgaagtagttatgggtacatcttccttactttgatgtgtgtgtgtggggcggggagggttaacaacccattctttttatttcttttattcttctactgtctgcaatagtatgtgtttttatttgttagctttatggctcactataaaattcacaggttatcaaaggagaagtatgactcaactagaaaaagaataaacttcatttaaagatgtataaagtgacacaagggaccttgcattttcttttggggaaaaggttagcatccttacaattttatggaagaaattgcatcctattaggtagaataattattttactattgtcttatatggaaattaaataccatcaaatgaggtatgacctaacgcaaagtttataaggaggtacaaaatggtggtttgtactggattaagcagggaaccaagtttcccagagtttccttttttgtatagtagcaggataaaattggccaaagagtaatgtgtgtgagctatggaaggcaaaagtgaaacagtagccactgctctctgaagcagtcatttgtcatatctgacaaatagacacggatatgcccagcaggtgccagcatgttctaactctgttccactccatgcctagcatgccttcctgctgaccagtcaccttcagatgcctggcgatagatgaatggagatggtaaccacacaaaggcaagagcttccttagacttctccttgaacttccccttcaaatcacacttcagcagctgcaaatgcttggtttctcagattaactggttagagtttccttctctggccctcccacagcccttagaccttcactttcctgtctcctttcacaatcacgtaaagccaaattcccataattaagcccctatcccatacaactcatggtgactttcctgcacttgacgataccctgattgatgcactagacaaatataaattagttcaatggaaagttgtccgtcttttaaaaatgtgtatccagatacctattgggagaaagaacaatcagaaatctagtcttaccagaaaaagagtagaccttaaaagaacacatgtagcaaggtgagttgcaagggaaagaagagagggaagaaagggatacagcctgtgggctcctgcatttccatgaaacactgggtgtaaagaatcaaatttactgaacttaaagtataataataaaaaaaatctatctatatatatatacaaagaatcagatttatcactatgtgaagatgtaggaattatttttaattaaaaaattctcatcagaaagaaattacttataactttatgaataatttaacatatgtcaatctaattctgtgttgttaaagtaaagatatcaaaggaatagctctactcccatgtttcagaaattcctggtagtataactgagtagtctttattagggaagacagacttctctaaacatatctggtgactcagtttggtgtatgcaaatatgaatatggatatgctatgacaagtgtccccaccccctcccccaactaatttcctgtgcagagacagctgtgtcacccatctccactgattctgcaagggacttgtcataaaaactgaataaggccaaggttcaggctctttagagtggttacttccctaggaatagaagtgtcaacgtgacttttataacatgctttgagcacgttataaaatttgtaaattgataggctcatcttctgctctcccacaagctcaaaacactgtgaattttttacatctccagaatagaacctcttgctcttgtgtggcggagccatcatcagttcttttaatgttcaccactctcggtagataaaagttctatttcattctaattgttctatgatatgatttagaatcactttaatgacacagtcttcagtgtgagaacttctcttggttccagcatgcataccccaggaggagcagaatctcctcaggtctaggggacctagtgggctgtaatactctctctttctctctctttctctctctctcactctctctctctctctctctcacacacacacacacacacacacaagcaacaaggtgaattcaccacaaatataaaattgtgagccaccaataacccacaatcagcctcaaagcttgctgaaaaatctcgcactaacacccctcccaaataaaacagttttctgtagcaaggcatagagtcactcatatccaatgattcaacatggggcttgtgatgcatctgtgcattgtgtattttgtacttttgttgtctaaatggtgagtctgtgtgcatgtgtatgagagcacgagcgagagagagactattacagaccactaggccccatggacttgcaaaatcagccttcttatacatgattcatgcatggatcctcatgttttgcgtgtgaccacccttcctaacatcaagtcataaatttcctacagacagatactgaaattcaactataatgaacggagttcatttgctgagcactcttggctataatttgtctgtgtacttttaaaattgcagatacctttgtccggaatgcccttttcctacaaagccaacttgttaatcttcctttatctcttaaggccccagctgaagggctctacctttgtagggtcttccctgactccacactgctaacctcctcagcagaactaatggatcaccgttatgctttcctcataaaaacactcatgtctcgtgctatgttgtaagtatatagttacacatttttctttctcttcaaattaccaggtatttatgaatgaagattgtcccataaccatatttgagactctaagccaggcacattgctaaatattgcataaaaactaaattaatattgattgatatataaatacacaaataaatcaatgaaaatttcttcactagaaagtctgaattatataggtttaaagtatataatatgcaacacagacaatttatcagtttctcctgaatcaattatttttaatagactatatatatacatacatatgtatatatatactatatgtgtatagtacatactatacatatgtatatatatactatatgtatatactatatattatatatgctatatgtatatactatatatattatatatatactatatgtatatactatatatattatatatatactatatgtatatactatatatattatatatatactatatgtatatactatatatattatatatatatactatatgtatatactatatatattatatatatatatactatatgtatatatattacatagacatatatattttttttgagatggagtttcgctcttgttgcccaggctggagtccaatggcgtgatctcggcttactgcaacctccatctcctgggttcaagcgattctcctgcctcagcttcccaagcagctgggattacaggcaggtgccatcacgcccggctaatttcatatttttagtagagacagcgtttcgccacgttggccaggctggtctcaaactcctgacctaaggtgatccagccgccttggcctcccaaactgctgggattacaggtgtgagccatgatgcccagccagacttaatgtattaatggacttaaaacacttttaatagaggcattttaacttttctgagtatttgtttcattattcttcaagtgaaaattcaaaatgtttattaccataataaaatatgcatcaaatattattttattatgtgttatcagtccttgctaaaaataatttcaaaaaacattttggaatttaatctcagctgaaatcactagttgccctactaattcagcattaaaagtacaattgattcttcttccttcctccatcatagtaaaccatggggaaatacattacctgtggaccaagagtgaagataagcagctatgttgcctttttggcatcttctggtaaatttcatgaatatattgtctatagactttacaggattatgtcaccgtttttctcttttgaaaatacagaacacactaaatgatctcattcaagttccaatagagataatttcagttcagaaggtgatctaatacagaagataaattttgttgtgctgatttgtgtttttgagagaggtacccagaatttaaatttaatttaattatgttgtgctatttatcatatagaaaatatgggcatatttgaagaccatattagaattcaattgcactaaagagtaagctacgaaacttctttgtgttctaaattcatatcattgtattaaataaaacatcatacccatatgcgtccccaataagtatcaatccttattaatgtttttaaacaagatgtctgccttagtatgccagttgacaaggtgtcagtcatttgaccttatgtaattctctaattttcagctatcattttctactattgctgtgtgtgtgtgtgttctctaaaaacttttccttctctttcaatctcttgttttttaactttttatggagaaggcattataaaatcatctttaggaaatacagaaacacatttacagaaactttctacatttgaactaaagggggcagtgcttcctttcataaagataaataagcttagagctccacacaggttgttcatatgtaaaatgaagggtctgtggaaggacatgaataaagcacaggaggttgaagtcagatttgcagctttctaggcaggagataagacaatctgcatcttcacaggagggatggccatgctcctgggggcatcagtgctgattctgtggcttcagccagactgtgagttgtgcatgggaggtttgaatatagtaagaaaagctacaaggaacactacaaggctgggagataattggagaagttttgttttgttttccggatcttgatggtttcctgtggggacattaaaaataaaactgaaaatctgttattctctttccaaacaggggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgttttcttaaacaaaagtgccaagcacctctctctgcacattgtgccctcccagcctggagactctgcagtgtacttctgtgcagcaagcgcacagtgctctccaggcacctgcagcccgtactcaaacctgctttggggactcagactgggagacacatagactcgcttccatttacacatgccaatatgagagattatgctttgaagtaggtgaggcaagttgagcctaaagaaagactgatacatgacaaaaccttacaaataagttaagaaagttccctgagttttagagtgtttaagagtctaaccactctccttttctactttcagaaagaggttgctgatttagctaaagcataaatctctagtgatgctttgtttctgctagcttctggaatgcgggtgccctgtctcccttgtatactagggggcaaggatgtgtgtttggaatgggaaaaccaaggtcctactgcaggttcttccagtgatgaacatttcctgagatgtcttttcttttagtttttctcagtgtacaggcatttctgagcaaagaattgcatgtgtgaatactaacttatgtatatctgcatatctataaatatttctatatgtagcataaccatctgtatctatattaagttaaacattcgttcttagcaatgtctccaatgctaaatcattaccacgtggatcacactagcctcctccccttacttatccataaattcccactacaggggtgcacagcctggctctcactgttaacaaaaagttattcagtaatacttgttaaaacacggtgaggcagaatttatttaggaccatcatgataggtacagagaccactgcaacaggattttgcagtgagggagaagaattggattcaactccgaatacagcatagacaagtggagatttctagccaaggggcagattaggggtcagtggataggaaattactaagaggaaacattagaaccaagggatagtctggctagaccagccaaacaggatccttgcagaagacaggtcagggtgatcagacatcaatcccctgggggatgatagaggatgaggagcccagttggatatggagtgtaatcagatatcaagcggaggatgacgagggcagcaggggagggtgtggttcttgctaaactgacttagaaggattcttgttaaaactacattttacaagaaaatgtacagatgagcttaggagaaacttcaaaagcctgactaaagtttggtcaagcaaagaatttttgtcattaccacccactattcatttacatcatagtccaattccattaaacatgtatagtggtatcagaattgttacttgtagctccatgagaaagaattttatcacttagagcacactgttgtgtaatggtaataatgtctagattatgttgaacttctattattccacctgttttgcatgtattacattaattcttctaataattatttaagacaactattagaataatccatattttagtagagaaaacaggctgtgggagttcagggatttgttcagtatcactaactttgtgagaaaagagagttcatggtcactcatgccccaaaccaccaagtatgggcccttcctacagaagctattaacaagtcatgcttttgaacagctagcaatctttaaaattcttatcatacatgtcttcatcattgacctatagaagagtgagattatcactcatagagaattaaaagctgaaattatggttttatatgtatattgtatttgtagataaatgattagagcttgttcctcacaggctgattttctgaagctgaagatctttacagagagaagatacagaaattcaggatacttcccaagaagcatgcggaagcctctgtaaatcccattacttatggcataatctgaacagtgacttcaggaacagtgatttcaggaatgctgaagacattttttatcagaataggggtgatatataggttggcttagctttgttcatctagggatccttgtggggttggtttaactataaggtaaaatctgtaggttgatcaattctctcatatttaattctatattcctgaacatggatgtaaagctaactcagtgtgaattagatttattatccctccatatccaggagcaccaatatcacatgcagtattttttctgttctttttatggcttacattggtataggcaggaaaaattccaagatccttttcgtaatgcacgtaaatgagaatgaaaagcaggaaggaatattaagcatcactcttcatacttagggtattccatgcacatctcgggctcctactctagagcctcagctactctgagcagagagtctgctgtgcatactctttgctcacaggcatccagagcctgttcccaaattcaaagctgtagccacagatcccagcaaaagggcagacacgcgagagttgttgctgtcttctagcagggtgtagagaaatgtagctacgatgaatcatttcatttcagtttcaaaaaatgtggaaattcagctgaataatcagtccagttactatatatccctgctcttaacaaaactatttcaaataccttaagacaataaatcagcttttcttcttttcagatatatttaacatgatttataaattactgaaacccattataaagttctgttacaatggacatttttcactctaactgctgttacatttaccccatttcatgtcttgcataatggggagggaatatattaatgctgtctttatccttctaaagcaacgtagaatcataccagaaaaaggaatactacattcaatctcatccctgtctttttgttcaagctcttcagactgcttcaactttcacatttcattcattcccacagttatctatttacgttcttttcttatctaatatatttgggaaacagcattgggaaaacatactttctagcattgttctagccataagtgtgttgtgtcttcttgagcaagtgaatcaacttcttaacattttatatcaggaccttcatctgtaatgcaagggcaatgatttccagctaacatcggtctcaagttttattcattttatcaattagcaattgttaactggttgcctgctgagttctgcataaatgttacatgctgggaaaaaaagagctatggaaaaatacatatcttctttgactaaattgtagtctagttagttatgtaggcagctaatcagacagagtaaagtgaaatgaggccaaccttgggaaagcaaagggaggtatgaaggcatatggaaagtcccacccccatcttagccttagaggtgagtcaggggcagcctgtagtatgtcttgcctatgctgagacctaaagatttagtaggagtcaatcaagttgaaagacagagaaggtagtaaaagtgatcttaaagatagaaacagcatgtacaaggtgacacagaacacaatgaacctgaggactaaaagccagaattatgctataattaaaattatgtatgtcataaaatgttcaaaccaccactgcaaagcagttgtaccttaattctcagttttataaatgagtaaccataatatttgtgaggttaccaaatatgttttctatttacttgagatttcacttaataaggttattcatttgatacctaatatgtgtcttagacttgaaaacaatagatgcaaatgagaagaataaggcattgtttctgccttcagggagcatgtaatattgcagagtgtattacaatatagtataataaaagctatcataggagaagcgtagaatataaccacctaacagtggcatttaatttggaaacttaaatgtaagggaaagctgcctacgggaagtagtatctaggttaagatctgtaaaacagttagccaaaaatggagtcagagacagggtattacagaaaaagataaatagaatgtacaaagacatgaagtcaatatttaggttaagagaatgacattaaactaattcaggatggccagagcatacaactcaaaatgtatgtcagtaaatataaaactaaagcaataagcagaaaccactttgtgaaaataattaaaagccattataagatgtttgtacattacattatcttgaagacaatgatgagcagtgaaagaaatctgcacaagtaaataatataatgaaatgtcactgtttgaaagattactatgagttcacatacttatatattatatccatgtgtgggcatgtatataaaatatatatatgtagtaaaatacatataatacattttcccttgatacttcttttttctcttaattctggagtaattctttctgtaacacagtatattgataggcccttcttatagcaagaaaaaaacctatcctgtatgaaaacttactcaagaaaagccaaaatccacagtttaatcaacattcctcagtctggccacaggggagagctgtttaaaaagtattctaggtagatgcatttagttctctgcagttaaactgttgtgatgtgtctctgattggttgcccccaaagttgcaatatcctggaagcaattgcaacaggcctcattctgagttcaaagcaactcctgttaaggaagcccattcagaagctgactggatattctggcaggccaaggatggagactctcctgaaagtgctttcaggcaccttgttgtggcagttgacctgtgagtacacgattcagtctgggagaggttgtgatatgacagcatcttaatgacaatagctttctgtcttgggaagggcccttttaagaaccagacctaagaagtgaggaaaatgtaccgtaattatgtggtgatgcttaatgttttaaataaggaaggaagagagaaaatcacccttcccttcacgagattgagcatctcattcgattgtctttctgatcaggggtgagaagccaacaaccagtgcagagtcctcaagccgtgatcctccgagaaggggaagatgctgtcatcaactgcagttcctccaaggctttatattctgtacactggtacaggcagaagcatggtgaagcacccgtcttcctgatgatattactgaagggtggagaacagaagggtcatgacaaaatatctgcttcatttaatgaaaaaaagcagcaaagctccctgtaccttacggcctcccagctcagttactcaggaacctacttctgcggcacagagacacagtgatacccaggcctccaagacctgtactcaaacctaaagctgagccgcagatgctcccctagcatagatgcccaccacaggagtatggggaacttaccagaaggttcatccatgataaaagagaaacctgaaggaaattcatttgcttcaacatataacacaaaaagcaagccatggccttaagaccatatctaatttggcattgttttcttgataattatttaattgctttgttggtattatatgatagataacttagattcagagaaaattacatagatttcagtttcaaaaactggagtgaattcctatttgactgaagctatacatataaactccttttggatctctgcattcctatctgaaagtgaaaagtaacctctctttcttctcctaggtacccacagcttgacaataggacagcaaaaaaaaaaaaaaaaaaaattgtctggttctttcttggacgtgaggattgtacacggtaggtatttagattgttaatcttgttacctatctggaaaggtcactagcattattttttccaaggttttaaatatctgttttggggaaatggcatttagaagtacttcaattttatatttgccttgccttctcttctcattgaggtttattctgattgatttccagctttgcccaagggaccctgagttatcttaccagtttgcccaatggtcaagatccttcctcaattgttcctttcacatcaacccagcacaacactgcatgtaggaaacactcaacaagttttaattgagtcatatgttgataagaattgagaatggccaggtgtggtggctcacgtctataatcccagcactttggaaggctgaggcgggtggatcacttgaggccaggagttcaagaccagcttggccaacatggcgaaagcctaactctactaaaaatataaaaattagccaggtgtggtgacacacacctgtaatcccagctacttgagagattgaggcatgagactcacttgaacctgggtggtggagtttgcagtgagccgagatcacgccactgcactccagcctgggtgacagagtgagaccctgtctcaaaaaaaaaaaaaaaagaaaaaaagaaaaagaaaaagaaagaaaaaacaaacaaaataatcacacacagaattccttccacaagatcagtcttccacaaacattctacaacttgcttaaatctttagtcttgtcctatcagtctaccctagaacaaaaatttaatttttcaactttctatattcattgagttttatccatcattttttttactcagaaaactttaaaattaactttttaaaaacttaattttaaaaaattaatttaaaaagatctccatgctgggaaaaattactttctctttaacagaaaccagattcccatgccttcttagaagctttttatcaaaaacacaaaacaactttatacactttgcatatataactgtttctcttatagctagtagtttgttgttttgttttgtcttgttttgtttttgagatggagtttcgttcttgtcgcccaggctggaatgcagtgatgcaatctcagctcactgcaacccccgcctcctgggttcaagcaattctcgtgcctcagcctcccaagcagctgggattacaggcacacactaccaaacttggctaattttttgtatttttagtagagatggggtttcaccatgttggccaggctggtcttgaactcctgacctaaggtgatcgggccgcctcagcctcccaaagtaatgggattacaggtgtgagccactgcgcccggccatagctagtataattatatacataaactgtaatgttacttcttagtaactcttattcttagtgaaaaactgaggaagtaagtaattctaattaagcaccagatacagagtccaagacaaaggacaatccctggagctaggcttcacaatctcctaaaggcccaaatccaaaaacatagtttatagacaagttaagtgtcaaaaattgtcataaaaacacattttatgatcttaaaacatctagcagagataatatctgaacaacaggccaatagacagacaaaatgtctaaattaaatttggaagaggtttctattttattttatttcaccaataatttttaaattgtctttatttgttaaagattactaaagtcacatgaacttaaaggtgtttgagttaaggtttctatttttctcataaaatatttaagtgtttactttttaagtcaattaattagaactctttcacatattttggttgtgaaacatcacatacacataacacatataaatatatagacactagacacacagacacacagacagaagcagatcttgtagaactatatgattttttatttaccaaatttaagtagttgtttttattcacagtttcaattacctattttattgctctaggcaactgttaggcgaccctaaatttgcatttctgaagtgataactctcaggtgaaacaagataaaggatttgcatctcaaaatacagacagagacagggaatttaagctctttaaatttggttgtgttagaggaagattgaaaacatggatgccaagtaacacaaaattatataaatttatcacgggcttttataaggtgaccaatttcatttagataggtgcttttaatttagtctcttttttatctggaccattgaattcaaagcataactcacactaaatcttgggtcccccaaaagaggtaaacaccatggggattaggacacgccatgttttcactgtacatttcactgcaaatacatttcccctgaggctggtgggcaacccattgccaatcagcccactctgcgatcagcccattccttagccattgtacacaccaaaggcaagcttttcacaataaaaagaaatttctagtaactccagaagcaaaaatttctggtagtgcaatgcaaaggagagaagagttttagatctgagaagacactgtccattttcaactcttgggattccctgaggaaaaaaatagcagtttctcccataaatgggtctgtggcacattttctgttttttcttaaggaatcccaggctgttagaatttgttgttgttgttgtttgtttgtttgtttttgtcttcttatgtggcactgagggtggcaagaggaaggaaagggcgatagaaagagagagacagagggagtgcacattcctagcagcggtttaagaagaaattcagttgcctgagaaatgtttacagagagagagagaacagaggccttaaagcagtaagtaaatacatacatagcctaaatatcagttttaattaagtcaacttttgactatggagccctttaaataaatcctgtcaaatctcttattatcagattttagctgagacaaacagttgatatttctgacttttgaacttctttaccaaaagatatacccccaggtgccttaatcaaggttattatataaccgtgggtacacaagctgtctccaaagagttggcaagcattttttaacaagatccagaatcaccccaaagatcgctcagcgaaggaaagtttcattaccaataaatggggtataacccatatttctgtcaggccatgtgtttagagtcttaccttctcagctgaccatatgcacacaaaggccccaaagcctcatgtgcccccaacagatgaaaaaagacaggaaacaaaaagctatggaagtgggaaagatcaatcataaagatcaataataaattgatacccaacaaaaaagtcacacaaatattaaaccgagaggggctggatccctgaccagtaatcagactcaccctgtggatgtgaaagtgcagaattttaactattgggccacaggtggagtggcctttgtttttccttgaccagaaagcaaacccaagcctctgcaggaattttacctaccagaactggtttaggtcagatttttcactcttaatttagtcaagagaatttttaaggctggccatgacactattatatgtcctttttaaatgtgatctctttgttaattgtttagaataagagatccctaaaatctttaaattaattgcaccgaaagaaaggatgggaaaagggtcttgttgtgtaaatgaaacttctcaggtagtcaaattgttgacctttcttacccagccagggtttttagaagtgaaaattgactttctccagctgcagagtttcattcaacattagagggggccaggagttggtaaagtctaacagaaggtggaccaaaactgaaaagaaaaaccagaaaaagtgatcacagaattcacatataattgcgatctctcagcataagggtaagttatagccaactgacaataaaccttgcccttcagctaccaaatcccaatatgaaaccagctccttacctggagatggacccaagctgaagactgctgtctgccatcatggaagcagaaactaccagaaaaggagttttacagcagaataaacctcagatcccaattgaaaatttgggggagatcagggatctctggagggagaagttcccagaacttacatagcaaatcatccaatctgtaagagtaataaagagctccagccggtaccagggccccaataggagacctgctggaggccaagagccagactccactcagagtcccttcgtggtcaccaacatgtaagccaaaaagtgactgaggcagatctctattgattagaggtttattttgccagtcgaggatatgcctgggaaatagaaacataagtcacagtaggatccttgacctgtgtttttccaaagagggttttggaaacttaactatttaaggtgtaagagcaagcaggagggaaaggggaaaaaaggagggacagtaggcaatgagacaagtggttacattcttataaggctttgattaacactcaatgaatccacattttgtgtgtgaaaaaaagagagtagaggaaaaaatcaattaagcattcatctcatcctcagtaaatctacattttacatacgatagagtaagcatgtgaaattagagttacctgtttgggaacagaaggaaggcagtgttttgtgtgactccgtttccaaccttaattttccccttggcataataactttgtggttttcagattttatttttctttccagattgagattcccatgaccccccatttgagttcaattaataattaatttgctagaacatctcatagaactcagagaaacacttacttacatttactagtttattataaaggcatacatatattacaaagcataaggatgaagagatgcaaagggcaaggtatgggggaaaggggtgcagagcgtcctcactgtcttggggcacaccgctctcaaggaacctccatgtgttcagctatctggaagctctctgaacctagtccttttaggtttttatggaagattcattaaacaggcataattgattaaatcattggccattggtagtcaaccttcagactctctccccttcccagatattggggatggagctgaaagtcccaactctctaatcatgcctttgtctctcccatcccccatcctgaagttacccaggggctgccagccatccgttcagtcaatcattaacaaagataagacatcgcttcagagtttctaagtattttaggagtcgtatgtcaggaaaaggggtcaaagattgaatatatacttcataatatcacaagtcataaaactgaatagtacttagcaaccaaaagaaataaagtactgattctttcaccaatatggataaattttaaagcattattctgaaagaaataagctagacacaaaagaatacctaccatataattgtatacatacgaaattttagaaaaaagcaaatctgatcgatggtgacaaaaatcagatcagtagtttccaggtattgggaatggaagaaggacattgacaacagtaagtcacataggaacttaaaaggtgataaaatattctatatgttgattaggatagtggttacacagatgtaaatgagggaagagagagaccctctcgtactgttttatattgttttatactcagtacctgttttaagaaaaaacaacaaggaagtaaaaccaaagacaggcagcctgacgccaggcccgaaaccaggtctgggcctgcctggcctaaacccagtagttaaaaatcaactcataacttagaaactgatgttattcatagattccagacattgtatagaagaacactgtgaaactccctgccctgttctgtttctctctgaccactggtgcatgcagcccctgtcacatacctcctgcttgctcaaatcaatcacaaccctttcatgtgaaatctttagtgttgtgagcccttaaaagggacagaaattgtgcacttggggagcttggattttaaggcagtagtgtgccgatgctcccagctgaataaagcccttccttctacaacttggtgtctgagaggttttgtctgtggctcatcctgctacatatacatttttcaaaaacagcttgactgttatgcttaaaatgtgatatattatttcatgtaatttatattcaataaaattaatctaaaaaagattaataaaaggatttagattctagatctcatgataatctgtaacacttcttttaactcaatagaagtaattcctctgttttaattttgggcaaaaaataaaagaaagagataagataacaagaagtaggaaaaggaaggtaacaagaggtagtatgcaggaattaaaattcattctcttaaattagaggacgattacatcccaggttcttcatttactgtatacgtgatcttgagcatgtgtctgagcctctgtctcctctctgtaataatttctcacaagattcaactgtctcacaaggggaggattaagtaataatatgtacataatgttcctagagcatgataaatgttcagtgaattttatctagtatttttattattaaccaaaggtggtcattttaagtgagcctaggttctctaaatcaaattatgggtggtaatcaacatggtatggcagctccagaatatttttttaatctgggcaacttgaggggctaggggtaaaagtagagaaaaaagataattgtattattatctcagaaactgtccagtagcctggaatcccaagtgctatagtttgaatgtttgtccccttcaaatctcatgttgaaatgtgatccccagtgtcagaattagggttgaatgggaggtgcttgggtcatggaggcagatccctctgaatagattaatgctctggagtggagagaatgaataagttctcactctgttagttcccaagagaactggttgttgaaaagagcctcgtatgtccccctctctattgcttcctctctcactttgtgatctctgcaaacaacagctcccctttgccttccaccatgagtggaaggagccggaggccctcaccagaagcagatgctggtgccattcttcttgtatactctacaaaatcatgagccaaataaatttattttctttataaattacccagtctcagtattcctttatagtaacataaaatggactacgatgatgggaaataatattttatcaatggaagtgatcttctattataactgagccaagagaaataaaattgaatagaatggaagttttcttttgtcttaacaaagttaccaaaatcacacattgggaggataagcagaagtctaagataatcagaaaacagagtagactgcaaaagaattgtttgaaatcatcaattaagatggaaaggaggcagggaaaacatcatagtttctagtatcaccctgaaattttgtgtgtaacaatatatgtatgtctatctacatccaaggatacaaaaccacatctgtattttaaagtaaaatatattttcttcactcaaaaaaatatataggtatctttttaatctcagtctaaatctgggaataaaattttgtggccccaaaatgtctggagaataactaagcaaactttgctagggaaagagctgtcttaaacacatctagtggctcaatttagtctgtgcaagtatgagcaggatatgatttaacaacttgtccctgcccctgccttccccactgtaccactttctttcctattctgagacagatgcattgctcacctccaataattctaggtggagctttatacaaaactgaataaagtaggtctcaggctctgagcaggcagttttttttcctagaaatagaggtgccaacatgactgttggcagcatattacgggcactcatggcctctgccttccttggtaaggacagtagctgataggctgaggacagtctaggactgggagaagacagtggggagggaagaggggatgaacaactggtcatatgtgacaaacactcaggtgtaataagaaggaagaggaaaggaaccagattctgactcctgcctttactgaaggtttaacccctgccccaaaagttcttggaagctctcttacaggtcagctcaggggaccaatcttgttatttcttctcatttacgggatccagcatgtcacagagggtcattcaatcccaaccagcaatatctacgcaggagggtgagaccgtgaaactggactgtgcatacaaaactaatattgtatattacatattgtattggtacaaaaggtctcccaatgggaagattattttcctcatttatcagcaaacagatgcagaaaccaatgcgacacagggtcaatattctgtgagcttccagaaagcaactaaaactattcagcttatcatatcatcatcacagccagaagacctgcaacatatttttgttgtctcaaagagcccactgtgaagaacatgttagaagagccttacaaaaagatcggaactcaacctgaggcaattgcctattcccacattctcaggaaaaactcacaaaccttacccaggcatttgttagcagctggtggttagggtgcataagataagacccagaaaggaagtcattgagttcattccaggaagcacaccctcacaactgccttagaaaccacacaggaccacatgtaaaagccatactgctcggatgacatcacatctctatttcttcccatggagtatgccgtttaaaaaagcaacatgtgaaacatggaattttaaagcttaattgattgtacaggactttatatctgctcaaccaaatctcttgaggaaaatagtatggaagacactagggaaaaaaaacacgcatacaaaataaagatttttatggcaggatccctaaacactggccagagagatgcaatcttggtgagactatagactggagtacttttggaccatgtagaacagcagcctattctggaccagatgcatttttctatctccttggctacatttcactctaatcctgccaactccagcttggcttaccatgctttctgattctcatgttccttgcagctgggtctgctagttgggtcctccctgcagtcacatgcctatcacaagatttggttaaccacaacagagaaaggagatatgtggggagacactgctacagatgctaggatctgtagttaatcttgtagccacctaactaattcatggaaactccagaaatgagactgcagtttctaaatcccgtatttctttattcagtccccaaacccaattgtttcggtcaagcacataagactagtcttctgactctgatgagtcatttttcttccctacagattctcctaaaaatccctcctatgaatcctctgctaaggatgctaagtgaaccctatcacatgtggctgcaggcctgacacagtgcctaagccttaaccttcctcttctcttaattctgtgctctcagctaaggttttgacaacttgccaacaccaaaactggaatacacaaagtatctgccctttcttggttgttacctatttcagagcaaactggacattcctcctctaaaattttatctatctgaattcaaaataagattgccatacttggattcttactctcattggttcagtcaatcacttgttcattcaggaaatgaaaatatgtcctacgcaaagctcttcagttgcttctaattgtttcaagagaaatatccaagttctcttgtatggattaaaaattgtttctctccatattttttttattaagcccaaggtagataaaaatgtggagactgctctgtagatattcataatatccataatcgcatcttcaaaatctatgaagagcccagagaaaacccatccgaaccaaagtaaattgtaattatctaattcctcagccttgctatgtttcttgggatttctccttattgagtccaaatttactaccatgactcacaacctaactgaagccacagaataaataactcagacacttgccaattcttccatcaagcggcccaataaagactctagtctctgtgagacttttaacaattaaatataaaattctctcaacattttttgagaaaagaccttagtcttcttttaaaagaaaatggaagggaaaatggtgcagcagaagggaaaacaatgccctccttctcagactgaataggagagaggtatttcaattatgatctgtgatgtacagtgataatatgatttgcaatgcttcttatggttcagagagaatactgacaaaggtcttgcgtttctgataccaatatttcaattttagatgcaatggaagatggctagagttcccattcctgctagaaaagagtgttgcttctgcctcaataagtaaagctggataaatagaaaaattgtaactttgctttaacccatcagagacctgagattacagggcaaataagtaggctggactccaatgaggaaaacactcctccaagggagacaggcagcttatggactggcacaactgcagcagagcatagaaaaagaaatgttatctgccatacaagcaagaaaaagaaactgggtaaaagattgagtgagagctatcatcagaatatagaactgctgggagttgcagacatagaaggagtttatattcactggtagggccatttcacagatgttggaagaagtaattaggggcagggtgagacacagagagagccccagcaaaagtgtaggcttacaagacataattggcagtcactgcaggaaagcacaaatcccagcattcttgcctaaatcagcctcttgcaggaggaaaagctttaagctgttggggatggggctaaagacctgacagcgcattctgtcaccccctagagcacaggttaagatccacaacagcaaagaaaagagtcaagggaaaaaaatctctacctttgggtagagacaggaaaccattctgagctgaagaccctgtaacaataccattctaattttgctacctgtaagaaagaagcagaaaactctctcacaccacacccacagagaaacacggcagtgtttggctgccacagggaggaaaggtatgaatgctgagaaaaccctaaatccaagatccaagcacatggggccagtctaagattgaagctggaccaagacaacagagaagtccacctacccacacagcgagcctcgtaagcactaaataacaagcaacggcaaactattgctagaggagtgaggggtgaggaacagaaagagagatcctctttgtgctgaaggaattcagggacagctaaaagctgaggtagagtactctaaaaaatagagattcataaatcaatagtaattcaagaagccagcttttaagtggctcacaaagcagtaagatggttttaggaaaacttatgtatttaaggatagtattctagaccttctattttcagatccttctacttcctactttctattcctggagacaacatggttggataccactatcagagccatattaggctgactgaaccaccattgtgacttgcattatattatcttctctcaattctttatctccgtggagttttaccttaaaagatgttcattcatatacttttattcactaggtataactatgaggaagctgataaaaagggatgtttctcattagtcttttgtttatctaagatttgttgtaggttctgatacattagcagaataatataatcaatactttgatttgtttatcagatctatctaggttcatatgctacctctttgtgttcttgaacttcttcgagtctttgaggattaaatgaaagaattgatatcaaattaaaagcacagtggttggcatgtggtaggcaccaataagccactaataacagctcttgaaatacgtcatatcctttcattgctcctttacaacattgagtttataacagggaaaaaaaataaatattattgcacagactccaagagactatggactgggactcgagtgcataacattttttacttgcaatgtacattgctgaaatctagacaccccaaacttcctgcatctgcttaggcttttcaatcacggaagaccactgcactctggcaggaaaaatatccagatgcctaacttggaaaataaactaaattaggccatcttgggaaatggcatatagctctttggagggcaactttatatttaccctgtcttctgatatgttgaataaaagaagtttaaatgagacatctgctttagtatttggcatattgatataggtgagctcttacactatgaaagtatattggaaaggatatgacaaagaatatgctgctaaaatccctgaaactcgttaacacttaaaagtggttgatttcaataataaatttcaggcatctcaggaactgatttcctcaaaagtatgatttatagccatctgattgtgaaggcatgaacatcctcattctttgacattaaaggagaaacttggcaattagagggagatgcatgggcttgattctagtcagtaaatggttcaggcagagacaatgacattaatctggggctttttatattggaaaacacaagccaagaaagaaggtgcaaatatctttgccataataatgctggtgttatgatttcacaagaagtaggtgtgaatatgttttactaatgaaaaaaatgcattcattcctcagatagactacaatgattggactatcaaaggaaaattagctttttaaatactaagttgtgtgttttcatgtacacgtatacacaagtcctggctgtagctttactgatacagagaaaacaaactgaaattgaagcactgacaattttcacctaccctctacctttttcatggcagcagagctcaccgtgtcttgcaaagttgttaatagctcaagcaaacaaagaccccattgatatccaatatatgtgcaagatcccattgatatccaatatattaaaaagggactttgatctgagctttattatcctgtagaatggagtgctaatgtcttgaagtacaatggagctagtataccaaatatcatgagcttaagaaccaatagagagggaaaaaatgagacaaggaaacaaaaattttgatgtgtgatggattctattggtctatccattgaagccttgctatatcaagataccttttaaatttatactgttcagaacgcatattgaaactgtcagtaaaaaagatctctctactcttccaacagagtccattgtatatttggtacaaaaataaaacatctaaggttgtattccattcttttgaatggaagctcagattaaagtcccttttaatgtcttgcacatatattagatatcaatgggatctttctgccagccagcagataattccccaatgcagatgaaacctgttttaaatagtacttctacttcagaaactagttactaaaaatctctttgggaaaaagtcaggcacataattgtgatgtgtgatggatttccttgtctcccaattttttctctccttggttcttaaaccgatgacatttagtataccagctccatggtacttcaggaccatgtacatcaatcctctctacaggataataaagctcagattaaagtctttttaaatgtcttgcacatatatcagatatcagtgggatctttctgccagttagcagataattcctcaatgtggatgaaacctgttttaaatagcacttctacttgagcctgagaggcggaggttgcagtgagctgagatcacaccactacactccagtctgggtgacggagtgagactcagtctcaaaaaaataaaaaatatatagcactcctacttcagaaagtagttattaaaatctctttgggacaaaactaggcacactgctctgaatacttcatgaaataataatttttccaacgcctttctgagccaggtgttcctggtgttactagaatgttggtcagttctgcacaaatttacctaatttacatcctaagatgctctaccttttctttgcaatagccatcaattatgccccaattttttaaaataaatctattgataatatcatggaactggatgaggaattctaatattaagtctgcatgccaattcgtccaattactcagtagaggaaagccttccaattgaacttcattgtgtgcctgcttttgtgcttcttttatttaagcattttgaatatatgagactactttagcccttctattccattctcatttccttttcatccagttaaacttattgagagcctaaaatagaaaattcaacacaggcagtcctaaatttccaaaagaagatttgcaactaatggtagaacaaagaagcaacaaatttttttttggacagttttacattattgcctgggctggagtgcaatggcacaatcttggctcactgcaacctccacctcccgggttcaagcgattctcctgcctcagcctcccaagtagctgggattacaggcacccgccaccactcctggcttattttttgtattttttagcagagatggggtttcactatgttggccaggctggtctcaaactcctgaccttgtgatctgcccaccttggcctcccaaagtgctgggattacaggcgtgagccactgcgcgcagctggaagaaacaatctttataatgtttcttaggaacaccatctgggctgggcatggtggctcacctgtaatcccagccctttaggaggctgaggtgggtggatcacttgaggtcaggagttcgaaaccagcctggccaatatggcgaaaccccatctctactaaaaagaaaataaaaaaattagccaggtgcagtggtgcatgcctgtaatcccagctacttggcaggctgaggcaggagaatcgattgaacccgggaagtggaggttgcggtgagccaagatcatgctacttcactccatccaccctgggcaacagaccaaaactccattaaaaaaaaaaacaaaacaaaacaccaccatctgtaagacatggttgaccagaaacagaataatgcaaggttggccaacatagccaaactcttctaagccatgagctctgcctctgtctcattgattggtgcctagctgctagagttcagtgataaaagtgaaatcaaaggctgtacattatttattttctttgactatgagtttatctttcctgccagatccaaaatgactaataaaatgagagatacagtcagtctagactcgaaccaggaagagtctctaaaatccaaatgagtaactctaatggtctctctgaagactctgcactgttgcttctttaaagataaacattaaaatagaaacccgcatctctaataaaatatttgtctttcccagactttcttgagagtgagtctggagtgaccattttgtggtaacagatcatcatttggggttattatttaagcaccagttccctcatatttgtgctgtcagtcacttcctcaaagcttcccattcagtatgttttaacttaagactcagaaggacacattgatgataagaagtttctcagtgggtctgaagcttagctccaacactgcttgtcttagaatagagactttatcttactaggacaccaaagaagactgttactacatggcatgaatatctgcttcttctttatttaaaaaaaaaaagtgcagaaggcatcaatggataacattctctatgttttcatttgagtctagtagttttctgttcttactttgtactgtcaggctttttttccccttatatctaccttaaaccctataaagaactactacagatcagaaactttaaatgcaagatctgtaacttaatcaccagaaatataaaccagaaatatgactttctactaatttcctacttgtgaagtaagatgttctaagggataggcagacatgccagctctccttctaaagacagaatgtgtgttatacacgtggccttggcaattagaggtctgtacacaggatggcagcacttcattttcacatgcagagaaatggaatgttcaactctgttgggcagagcatagcttgtctcctattggcttatagccaggttaagaaagagcaagaatacactgagaatagaatatgttctccttcccagatagtatagatcattgatgattctaatggcaagaagaatggaaaagtccctgggagctttattcaaattcagctgaagcgtaagtgcagggcttctggaggggtccatcacaagtctggggaaggagggggattcattttagttctcccctggttttctgctgatactctgcaaagaaaacgtacattcggaaaatgacccagtaacccattttccttgtttcaacggtgatgactggccaagaaaaggatgtgatacagagttattcaaatctaaatgtctaggagagagaaatggccgttattaatgacagttatacagatggagctttgaattatttctgttggtacaagaagaaaacggggaaggccctaatatcttaatggagattcattcaaatgtggatagaaaacaggacagaaggctcactgtactgttgaataaaaatgctaaacatgtctccctgcatattacagccacccaaccaggagactcattcctgtacttctgtgcagtgagaacacagaactcttcaggcacctgcaacctgtactcaaacctgcaactgggagtccagtcacattctttgtctttgaacgggttttgggttagaatggtttaccataatgtgcttgtttctaaattgaaatgaatgcagaaatctaataattgtgattacaaaatcattacgtttaaagtaactcaaaatgagctggtatactttgtactaactccaatgtattcgagaggagaagtagtgttgttttaaatagatatgtaaataataaagataacctcattggaatatctgaggttgtttcattgagatcctacacttccataataaaacaaggacacctaaaactcttctgggtggcaatctgctggccttcagaaaaaaaaagaagattcatttttgaaaaaattttaaaatttttaaatcatcatattttaaaatcatcacacactcattatttattataagtattttcattccaggtgtgtctgcatatgccctaattcatagcaacttaacatatcaagtatatttatcatataacatttatgtccattctcctctggacatccaccttcatagtacgggtattcagtcataaaagttacaattcaaatagccaccagaagaattcctgcaaagatttttgtcttgcaactgttctacattcagaaaatatttaccaactgcctactctgtgccagacattgttcttggtgttgaggattgagcaggatgaacagaaagacatgacaaaatttaattgtattctgcttctctcctccaatggatgtctgctcaccagaaattaactggggaaacattttgatgacagtgtatatccagggatcaatgacaccacctaggagttttaggattttgcccaaattcaccaattccttcatacctcataggtctgtatgtacagtagcaacagtgtgatctttctcttttttccaatgttccttcaagaaaggaagataatagttattttagtcaaactgttcaaaatagagaaaaaaacctaccaactccctcatgaggcaaaaaacataaacaaaatctgtagagttaagagtagtgaggctgggcactgtggctcatgcctttaatcctaccactttgggaggccgaggcgggtagatcacttgaggtcaggagttcgagaccaaacttcccaacatggtgcaaccccatctctactgaaaatataaaaattagctgggcgtagtggtgtggacctgtaatctcagctactcaggaggctgaggcaggagaatcgcttgactctggaaggcagaggttgcagtgagccgagatcctgcctctgcactccagactgggtgacagtgcaagattccatctcaaaaaaaaaaaagagaaagtatttttcatataaattattctcggatttttgaataagtaataagtatacatggtataaaataaaaattatacaaaaagatatatagtgaaaagtaacttttctctttacctctatccccactatccccaacagcctagtataaccactgttacactgaaattttctttgaacattatacatatatacatatatatgatgtgtatatatatatatgtatatataaaaatgatgtatgtatatatgcttgtgggtatatatataacatatatattaatgtagcataccatccacactgttctgttaccatgctttcttacttaaactatatcatgggaaaccatcattgtcagtacatgaagacagctaccttattatttttaatctaaattttcaaacacacacaaactaggaagaattgtataatgaactcctttgtatctttcattcagctttaacaaccatcaactggctatctccttctctttaaagtttcaaattttgccattgtgtgactataccacattttatttagtcaatctcttgttgatggacacagattgtgttcaaattattagttttgtttgtattgtagcatagtttagtaaggtacacagatctcaagagtacagttcaatgagttctgacaaatgtatatgccatacaaccatcactgaaactaaaatatagaacatttcccataatcctgaaaactctctcatgtttcccccccagacaacacttccactaaagtaagaattgttcttatttacataaaaccatagaatagttctgtttattctattttgataaattgagatataattcacatagcataaaatccatgcttttgaagtataccattcagttatttttaatatcatcacaaatctgtgcaaccatcacaactaattcctaaactttatcatcactcgccaaaaaaaaaaaaaatcatacctattataagtcactctcatcccctcctcagcacatctgcccctaacaacgccttaatctgctttctgtctctatggcctatcctagatatttcatacatatggaattgtacaatatgtgacctatcatgtcacgtattgtatgattcacatattcacatattttactggctttttcacttaccataataatttcaaggctgaacatttgtgaccaagtttttgtgtggacatacgtttttagtatttggggtattatgcataaaaatggaattgtgggtcatatggtaattttatgtttaactttctgaggaactgccaaactatttttcaatgtggcttcactactttacattactgtcagcagtaagggaggattccaatttttccacattctcatttgttattgtccgtctttttaattagacccatcttagtaggcataaagtagtatccctctgtggttttcacttgcaattccctaatgactaataaggctaagcctatcttcatgtgcttaatggccatttgtgtacctgctttagaaaatgtctgctcaagtatttgggctgtttttaattgggttgtcttcttattgttgagttgtaagaattctttatatgttctggatactagacttttatgagacatatgattggcaaatagatgctcccattctatagattatgttttttttttttgctttcttaatagtgttttttgaagcagaagtgttctaaattttaatgaagtctaatttatctattttttctttagttgctggtgctttatatgtcatatttttaaaaacattgcctaatccaaggtcacagatagttatatctatgttttctaagagtttcatagtttcagtttgtacattgaggttattgctccacttcaagttaatttttgaatatggtgagaagtagggatgaaagttcattcttttgcatgtgaataataagacatttggagtccccaaccaaaagaaagctgggtagctatactaatatcagataaaattgacattaaaccaggaattattactagagacacagagcaacacatcaaaatgattgagtacgatctacccagaacaaattctatttttatatatacctaatggcgtagcttcaaaatatatcaaacataaatcagtagagttgaccagtagaattaaattggtagaatttattgattaaaagatcaataaataattatacaaccatcatgtcaggcattaacacacatctctcagtagaaaagtattgaaattatgaccaacacaactaatatcctttacctcacatacatagattgaatactttacctcaaaagaacagattacacaaggaatatttagcaaaattgactatattctgaaacataaagtaagccttaatcaatttcaaagaacttaaatcattcagaatagtcatagtctctgaccatatggtattaagcaaaaattcaataacaaaatgattattaaactttattcctgtaccttgctagatataaggttaatttttcaaatgtattgccacagaaaacaccaagacaaaacagagatttggggtagggtagatttttcagtctctgaatagagcaatgtaacatactacttgcacactttatttcctgtttgggggcagaaacactgaacttctccagggactttgcactcaggcactcagagaagcattttgtttccaggcttgagtgaggaagcaaatttcaaccataagaagaaattctaccatgctctgccctggcctgctgtgggcattcgtggtcccctttggcttcagtacctatgggcggccccaaacatgggactgcagcttcctcgagagctgggctgcacaaattggaactggtggagtattaagtaagaggtaagggaagtggggaaatgaaacactatttaattattttctttgtccttttgccataaattaatctagtcctcatgacccatctgagacatttaagggaaccaactctgttttctcctttttcccataggatccagcatggctcagaaagtaacccaagttcagaccacagtaactaggcagaaaggagtagctgtgaccttggactgcatgtttgaaaccagatagaattcgtacactttatactggtacaagcaacaagcaacctcccagtgaagagatggttttccttattcatcagggttattctaagtcaaatgcaaagcctgtgaactttgaaaaaaagaaaaagttcatcaacctcaccatcaattccttaaaactgactcagccaagtacttctgtgctctcaggaatcccacagaagtagaaatgacagtggaagataaacaaaaaccttagcactccataaaggaagccacctgctcaggagcttagggaaaatacatgaagcacagacaggaagaaggcacattagtggcacagttgagaccttataatgtaaacattcctctgtaaaaaaaaagtttccttattgagtttatatataaagcagcattctttcttgcgatttccaactattacgtttctatcttgggttaaagtaaatcacaaagtgtattagtcagggttctctagagagacagaactaataggagagttgtatgtatgaaggggagtttattaaggagtattgactcacacaatcgaaaggtgaagtctcacattaggccgtctgcaagctgaggagcaacgaagatagtcggagtcccaaaacctcaaaagtagggaagccgacagtgcagccttccatttgcggtcaaaggtccgagagctcctggcaaaccactgctgtaagcccaagagtccaaaagctgaagaacttggagcctgatgtttgagggcaagaagcatctggcatgggagaaagatgaaggatggaagacttaacccgtcaagtccttccacattcctctgcctgcttttatcctagttgagttggcaactgattagatggtgcccacccagattaagggtgggtcagcctctcccagtgcagactcaactattaatttcctttggcaacaccctcacagacacacccaggaacaatactttgcatccttcaatccaatcaagttgacactcactattaaccatcatacaaagtgctttttaaaatcgttgctgaacaataagattaaatgaacctatgtatttcatgaaattcagaagcagtttgctgattctcatcttaaactgttgaatttccagatttgaagtagcactataaaccattttatcttccaatctcatgttgattttagcagtttttataaatattatcattttatttatttatatattttatatataaacaaatttcataaatacataaatttacttttatgtattttaatatataaatacatggtttttattgtattcagatagataagaaggcaattaatgttttgaaagaaatggatgaccaaaagaagctttgactaaaacaaactatgattgttagagatagaaaataattcttgggtgcttcataagcccagcagaaggtgggctgagaaaccaatttatccaccaaggcaggcatattccttaatatgtggtcaaaggagataagagaaaaagaatattccagaggactgagccagagaatgtaaaaaacaatgggcaaaataactccctgcatagagtgcagtcagaatctcatcaaagcagggtaggggtcttcataataatccaaaatgaactaggtatgtgcagaaaataattaacagtttttgtaacacactgagattttggagttgattattgtagcaggataacctagttactcaacttatctaaatacagagaaaaaatgagaaaatgttttcccaatttattttacaaggccagcatgattttgatactaaacctgaataaagaaatattttttaaaaaattattatgggataatctcactaaatgaacataaattcaaaaattctaaacaaactattagtaaaaagaattagcagttataaaaaagaataacatatcacaaccaagttgggttttatataatctttatataacatcttaaatgaattaaagtaataattctcattaataaaaacatgatttaataatctcaacagttacacaaaagtttttaatacaaagtaaatattcattcataataaagagataaatttatggcaaattaggaatagaaaaaaaagtcctcattctgctaaattatatgtattacaacaaagcagacataaaacttaatgaaaaatgttgaatgctttatttcaagaaagccaaaaaaacgctatccctattaaaaaagtatactgaaggtcctaaccaatatttaagaaaaataaagaaataaaagttttaataattagaaacaagactataaatattagccacagatggcatgactgtgatatatacaattccaaatcatttgcaaatatatattacattactgagtttagctatgtagtattaaaaattacattttatatgaaagcaatcagaaattttaaatgaacctttaaaaagtgtccttaaaataggtggggtgaactgggggtggagggttacgcctgtaatcccagcactttgggaggccgaggtgggtggatcacgtgaggtcaggaattcaagaccagcctggccaacatggtgaaatcccatctctactaaaattacaaaaattagccaggcatgatggcccatgactgtaattctagccactcaggaggctgaagcaggagaatctcttgaagctgggaggcggaggccacagtgagccgagattatgccactgcactccagcctgggcgacagatcgagactcgtctcaaaaaataaaaataaaaaaataggtggggatgactaatgggtacaaaaaaactgcaaagaactaataggacctatcatttgatagcacaacagcgtgtctatagttaataataatttaattgtacattttaaaatcactaaaagagtacagttagattatttgtaacacaaaagataaatgcttgaggggatggatacctcgttctccatgatgtaaacttttttttttttaagaaagtctcactgcgtcacccaggctggagtgcagtggtgcgaccttggctcactgcaacctccgcctcccagattcaagtgattctggtgcctgtctcctgagtagctgagattacaggcaagtgccaccatgcccgggtaatttttgcatttttagtagagacagggtttcgtcatgttggctagactggtcttgaactctgacctcaagtgatcctcccgcctcagcctcccaaagtgctaggattacaggcgtgagccacatgcctggcctctatgatgtaattatgcattgcatgcctgtatcaagacatctcatgtgcctcataaatatatacacctacaatctacccacaaaaattaaaaattaaaaaatgtaacatgtatatatccttaaaatagcataaaaatacaaaatacttaaaaataaattttaaaagatatttgcaaggcctcaagacaaaaggctataaaacattaaaaaacgaaattaaagatctaaagaaatgggagaattcatcatgttcatgaattagaagatttacaatgcaaaggcatcaattctcgcatatttggtaaatacattcaatgaaatccccatcagtatcaagagtgtgtgtatatacaagtagattctaaaatatatagtttttaaaagtcagtaatactcaaagcactccgagagaagaagagcaataggaggacttcctgtccctgacaataagcctatgaaatttaaaatatggtatggaggaacaggaacacactcagttacagatctcgtcagctgtgtgtgttcctttttcctctcatatccactctccacctttctcttccttgctgtttgtctcacgaggctgacctgaatgaaccgcatcaacaaggctcccgtgccctctgggttctagtggatttttgccagtgaggtgccctttgccaaaatctgaaaaaggtagcagagtaaggtcagggtgtttgttccttggttctcctcctgaggaatctcttctagtggcaaacatcatttgttcaaagatcacagctcctttcaacttggctctctccacacacccatctccattcaggttttgatattcctctctgccctctggacatagggatagtaaaactccactggcctaaagataataaaattaaaatgcagatatttctcaaaaatctcatagagaaagaagtctgaggattcaggtaaatgggaatgtggtaatggaattatctgatgcaatttaatcagatgcctgctaaccatactccctgggaatcccagaggacccttctttcaccaaggaatcaggaaattcatcattgagtgggtcaccagaattcttaaaatatttcttggaggccatccaacctctatacagtgaaggcaatggggacggggtgggcacattgccatgtaatttgctttcctggatttcagtgggtgtgactggatcctgttgcgataggtagtggagtttaacagatagagacaaagatagagtttaacagatagagaaagagtattaatcagagtcttttaacattcagagatttttggagaaagctaattaatcatagaatacctaggaaggaaagacagaatcagcttcctgaggctctactttatattatctagattttttgaggaaaaaaatatagttttagtagctataatggagattaataggcccttaatcaatcccaattgagaggcctaaaacatctgaactgagggaatggttgcatccatttgagaaagattatgccagacaatatcaagcattggcaaggatatggaacaactgaagctcttatatatttattatgttggcgctaggaatgtaaaattgtgccaccactttgaaaaatggtttagcaatttttataaagttaagcatgcatatactgtatgatctaataatttgcacccatagattgttaaccagaagaaataaaaaatatatattcacagaagtatttatgcagaatgtatttgtgaatagaaaatattcacataatattgtttatttcttttggataaatattcagaggtgctttattcattataggtcataactggaaaaaaataaataggaatgagcaatttatatatacaataacatggatgcattttaaaaacattacatggagaaaaatgtcagatgaaaagagtttatactgtttgtatccattaatttgaaactcgaggaacagcaaatttaatccatattgagagaaaacagatcagtggttgtctggattctgcagttggggaacccagacaaccactgattgacaggtagagaacacagaggaacaatttagggtgaaataattgttctgtgtcttgatttatacaacagttacatgttctataaatatttcaaaactcaccatatttcaaagcacttaaaatgggttcattttactgcatgtaattcatacctcaataatgttgatttttttaaaagaaataataaatattgctacatgccaaccaaaatgtctaaaattaaaaaagaaagacagagctaagtaatgaagagaatttgaatctactcaaacaagtaagagtgtaaattgataccaatacttaggaaaattgtttaacactaatttctcaatttgaatcataactgatgaaaattattttttaaaaagccaaagtctgggaaatcgtcctaagggcataccaaaaatggagaagcatttattcaagaaaatctactgaatctactaaatgtcagcaaacaaaaataaataagatgtgatatatatgtatacacacacacatataatagaatattattcagcctaaaaaggctgtttttatggatacaggttcctttttgggatgaggaaaatgttctaaaattgattgtggtgatggctgcacaactctgtgaatatactgaaaaacattgagttgtacactttaaatgggtgaattacatggtatgtaaattgtatcttaatgaagctgttacataaaaataaaaaagcaaagcaaaaggtaccacaatatttattgttcttttctagactcagtctggattctccataccatttgaatattgcagtaatgaacactatatgtttgacttttgtataatataactagataacatagagacatctacatttcatatttcttttcacaatcccaattttttaaacctatatatttataccagtactgaattattagtgtcatttttaatctgacacatatataacatgacacagtgaacagctgtcaaattaagtgtcactatatggctattgtgtcatatatggtcatattctaataaccagtctttatgtattatagatttgtgaatttttcttttttggaggatggagaataaggtttggtgtgctatttgaattttgctcacagatctaatctggcattttcacttttacttttagatagttttgttcaatttgttttcaaaaaaattagaagctttttgggggaacaattgcaagagtcattccatataatttctcccaataatgttatgagtaaataaaaattaatatattcacccaacaaattaagttctcaatctgtgccaaatcctatgctatacaatgagtaacatgagctttgggaactgccttcaaacatgtgaagaaccagataccacagaaaacaaaaggaatacattaattgagaaaacatcacataaataattttggggggggcttcctttattttattttattaaaaaaattttaaataggtttttggggaacaggtgctgtttggttacatgaataagttctttagtggtgatttctgagattttggtgcacccatcacccaagcagtgttcactgtacccaatgtgttgtcttttatccttcaccactcccacaccttcccccgagtcctcaaagtccaatgtaccattctcatgcctttgtgtcttagagtttagctcccacatatgagtgagaatgtacgatgcttggttttccattcctgagctacttcatgatatggtttggctgtgtccccatcaaattctcattttgaatttccatgtcttgtgggagagacctggtgggaggtaattgaatgatgcgggcagggctttcccatgctgttctcatgatagtaaataagtctcataagatctgatggttttaaaaggtgttcccctgcacaagctgtctcattttttgcctgccaccatccatgcaagatgtgacttgctcttccttgccttctgccatgattgtgagacttccccagccaggtgaaactgtaagtccaattaaacctctttcttttgtaaattgcccagtctctggtatgtctttatcagcagcatgaaaatgggctaacatagcatattggtaccagcagagtggagcattgaagaaaagatgcttgaaaatgtggaagtgaccttggaactgggtaacaggtgcaggctggaacagtttggagggctcagaagaagacaggaaaatgtgggaaagtttggagcttcctagagacttgttaaatggctttgacaaacatgctgatagtgatgtaaacaatatcatcttccaggataaggtggtctcaggtggagataaggaacttgcttggaactagagcaaaggtgactttgtcatgttttagcaaagagactgttggcattttgcccctgccctggagatttgtggaacattgaacttgagagagatgatttacagtatctggcagaagaaattcctaagcaccaaagcattcaagaggtgacctgggtgctgttaaaagcattcagttttataagggaagcagagcataaaagtttggaaaatttgcagcctgacaatgcaatagaaaaggaaatcccattttctgaggagaaattcaagccataatgaagatccaaatgttaatcctcaagacaaatggggaaaacgtctccaggttatgccagaggtcttcacagcagcccctcccatcacaggcctgaaggcctcagaggaaaacgtggtttcatgggctgggcccagggtcctcatgctgtgtgcagcttaggaacttggtgctctgcattctggctgctccagccatggctgaaaggggccaacatagagctcaggccatggcttcagagggtgcaagcctcaagccttggcagcttccacttggtggtgagcctgcaagtgcacagaagtcaagaattgaggtttgggaacctccacctagatttcagaagatgtatggaaacgcctggatgtccaggcagaagtttgctgcaggggcagggctctcgtggagaacttctgctagggcagtgttgaagggaaatgtgggattggacccccacacagagcttctactggagcactgcctagtggagcagttagaagagggccaacatcctccagaccccagaatggtacatccactgacagtttacaccacacacttagaaaagctacagatactcaatgccagcctatgaaagcagccagtagggaggctgtaccctgcaaagccacaggggtggagctgcctaagaccatgggagcccacctcttacatcagtgtgacttggatgtgagacatggagtcaagcgagatcattttggagctttatgatttgactgcaccgctggattttggactcgcatggggtctatagcccctttgttttggccaatttctcccatttggaatggctgtatttacccaatgtctgtaccctcactgtatctaggaagtaacaaacctgcttttgattttacaggctcataggtggaagggacttgccttgtctcggatgagactttagactgtggacttttgagttaatgctgaaataagttaagactttgggggactgttgggaaggtatgattagttttgaaatgcaaggaagtgatatttgggaagggtcggggtggaagtatatggtttggctgtgtccccacccaaatctcatcttgaattcctatgtgttgtgggagggacccagtgggaggtaattgaataatgcgggcaagtctttcccatgctgttctcatgatagtgaataagtctcacaagatctgatggttttaaaaagaggcattcccctgcacaagctctctctcattttttgcttgccactatccatgtaagacatgacttgctctttcttgccttacgccatgattgagaggctttcccagccatatggaactataagtccaattaaacctctttctttgtaaattgcccagtctcgggtgtgtctttatcagcaccgtgaaaacagatgaatacacttcacttagaataataatctccatttccatctacgttgctgcaaatgccattattttgttcttttttatggctgggttgtattccatggtatatatataccacattttctttattctgtcattgattgatgggcatttgggctggttccatatttttgcaattgcaagttgtgctgctataaacatgcatgtgcaagtatcttttttgtacaatgacttcttttcctctgggtaaatacctagtagtgggattgctggatcaaacagtagatctacttttagttctttaaggaatctccacactgtttttcatagtggttgtactagattacattcccatcaacagtgtaaaagtgttcccttttcactgcatccaaaccaatgggtatttttttaaatttttttattatgaccattattgcaggagtgaggtggtatcacattgtggttttgatttgcatttccctgataaataatgaggttgagcatttccagatgcttgtgggccattggtatatcttttctgagaattgtctagtcatgtccttagctcactttttgatgggattgtttgttttttcttgctgatttgagtcattgagttagattctcgatattagtcctttgtcagatgtatagattgtgaagattttctcccactctgtgggttgtctgtcaactctgctgattgtttcttttgctgtgcagaagctttttagtttaattaggtcccatctatatatctttgttcttgttacatttgcgtttgggttcttggtcatgaagtctttgcctaagccagtgtctagaagggtttttctgatggtatcttctagaatttttatggttttaggtcttagatttaagtccttgattcatcttgagttgatttttgcataaggtgagagatgaggatccagtttaattcttctacatgtggctagccaattatcccacaaccatttattgaatagggtgtcccttccccacattatgtttttgtttggtttgtcaaagatcagttggctgtaagaatttggcttcatttctggcttctctattctgttccattggtctaggtgcctatttttatactagtaccatgctgttttggtgactatggcattagagcatagcctgaagttgggtaatgtgatgcttccagatttgttcttttttggttagtcttgctttggcaatgtgggctcttttttgtttccttatgaattttaggaaataattctaaaaccccaaagtgactgaaaataatttgatctttcttagagaattatggtaggaagctctttgctgagccttgtcactagagggaggtagcacatccaaaataatctatctttagacctgaaacacaaaccctgaaagattgctaactgacttggttcctagttctatgtaaaggagttcacatatacagtcacaagagggagctgttacagctgcaaatccaagctccttccagggtgagcgaggttgtcattgagttgtataaggaatttatgttcattctttttgccaccttgtgctttattatctctttttgagtgtgtgcacagtttcaaagacatgggtaagccccttcccaaatgcagagcagaagtgaccctgaatgggaaaaacagagaagtgattaatacatagctcaattttaaatggtgaaatatttgttgctataatggactgacaagcttagttattgtagcagagataatgagtaattttaattttattccttcccatttctttaataaccacttttgaaaataactagaaaaaccccttcatagttacttctacctctcttatcaaatggcatcatttgatttccctctccaaacctcttcccatttcttcctttctccttcaatgtatgccactcctaggcatcatgaagatgagaaagcatatgttaaagaggagttcaagtggcatagaaataggggtcattcaagccattggctcctgtctcaaaaccagaggcacaggcaatgtctatctagaagacacttaggacattattccaggagccagtgtgggagacctgagtaccaggaaacttggcttctaacctgagttctaaatttgttctttcctttcacacttagcacagcaatattatacaattatgaaattacttttgttatatatgttgcaaataccttctttcattgtgtcatttgattttcaattttgcttatggtaattttttttaccaaaaagaagtttctaactgttgaaattaaattatatgctactgcttcttctaagacttactcgccctgaagatgtggatagaaattcccttctttcccttacagcacagggctcacatagacttcttggaataaagggctgttcttaccagctcaatgggttgtcaaactaccaattaatggtgggttttgtccttaccataataagggatgggtaatcccatttacttctttagatgtagcctacttgagtttcagccttgaaaatgatcttaatggaaactttctgaattaaagctagatttaaagaaaatattcttcccctctttttaaagttttatttttttaattaacaaataataatcgtattttatcttcttttaaaatgtatgtttaaacctgggggtgggctagacctaaccaggaagctgctctatctttagctgacgatttctggggagcactcaaattgaaacctgcctgatgtgggatgtgctgtggctgctgctttgttgcttgggacctcctctgacctaggatcagacacagagtctgagttctggggcctggaacctcaatgtgcacttgaacaatgaagttggtgacaagcattactgtactcctatctttgggtaagtgttctgggcctaagaaagcatagttttgtggctaatgacaaaagagagttatctgctgtctccatgttttctaccatgatttaccaattgcgggaaaaaatttgtttctatgtgtttcttgagggtgtctgagcgtcagtgtgaggggttggtcatatccactactcagagaagattctccaggtctcacagctctcaagctgtaaggagttttaggttcattgagctcaagggtcatggaagatgggaaatttatttttggccttgtggctctgcatagctcaggaacaaataaataccagtaatatttatcttgtcctgtgcaacacacataaaaacactcaaatatggagtagggcagggaggacagttctggagcagtggtgaacctgaccttcagatgcaccaagagctgatgatccagagctaatctgctgtttttcaaccccataggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagaccacagtgggacagatggggctgcagctgtgcaatatctccctggtgatgaaagggaaggcatctaacgaggccactgcacaagaaggagcagaagtttaatagaggaagaagaaaatttaaagaagaaaagggaaaagaagtaaagaggaggtggtaaggaaatcaatgagaggatgagaggattaaaggaatgaagaaactgagaaagaatagctaagaagtcctgaagaaaggactgagaagcttggcgaagagatgaagaatcacaattggaattctgcagtcaggaagaaaggaaataagaattttcccggacgctttcttttaatcaactcttgctttccatgtagacctcactataaaagatgagaaccatcatctggtagtcccaaagcatttcttcatctagccccaggcaagtgcctgggctttgaatattatatcacattagtccttccaacctctcaataattgaaatgaatttcagaaattgattcatttgcccttacgaaaaatttgaaattttatttgttactcatccatagcacatactcttgggatatagatgatttctggaagggagcaagaaagtggtggatatgtgaatattgatttcattttttaaatctatgttgaaatatctctattattaaacaaaaatacacaaatcttttttcattgtaaaagattcaaactattaagtatgcgaagtaaaaccttagaggcccaaactgactgtctccatctccatcccattttctcttcaattcctacaataacccattttgacagtttggagagtgccctgatgatcatactccttttcatttatgtggatactcacataaatatctacccaattttattacataagttggaacataccatgtgtatttgtctgcaacttgcttttatttttatttaaaaatagttttttgaggtgtgttcataccgagatacatgtgtatgcatgtgtgtataaactggccttattcttttcaatatctacaaatgttcacagtatggttgtataataattttacttacctcacctatatcatctctacatatataaatatatatgacatatgtgtatgtgtgtgtgtatgtgtgtgtgtgtacatattccttatagattccgaagtggaattactggatcaaaagatatgcctattttatatttttatagatattgaaaagttgcattccaaaatggctttaacagtctaacccaagatcaggaacatggcaaaaatgtctactctcaccgtttctattcaacattatcctagagaatctaaccaatgcaatgagacaaaaagaaaaaggaaaccaggctttacctattacagatttgtgagtttttcttttttggaggatggagaatgagggttggtgtgctatttgaatttttcccacagatctaatctggcatttgcctttactttggatacttctgttcaatttgttttcaaaaaattggaagcttttttggaataatttcaagagtcgttccacataacttctcctaataatgttatgagtaaatagtaattaatatattcacccaacaaattaaatctttaatctgtgccaaatcctatgctgtacaatgaatgacatgggctttgggaactgccttcaaacatgggaagaacaagataccacggaaaacaaaaggaatataataattgagaaaacaacacagaaataattataaaagctccgaagtgactgaaaataattctgtctttcttagggaattgtggtagcaagctctttgctaagccttgttcctagagggaggtagcacatccaaaataatctatctttagacctgaaacacaaaaccctgaaagatcgctaacttgactttatggtaaaggaaaccatatttaactttttaaaacgtaactcattttgcaaacaatagaattgtctgtgtagcaaatcctatagacaaaaaaactactgtaaccaataaatgagttagataaaattgcaagatacaagctcaatatacaaaataatgctgcttccatacagtaacactaaacaagcagaattgaaatttatatagatatgcatatgtatatttatgcatttatatatttatgcatacatatgcataaaaaacttttaacaaaattttagcagactgaatctaacaatatataaaaaggataatacataataatgaagtggggttcgtctcaagaatgcaatttatatgtatatgaatttcaattctgggccaggcacaggggctcatgcctgtaatcttggcactttgggaggctgaggcaggcagatagcttgaggccaggaattcaagactagcatggccaacatggcaaaaccctgtctcgactaaaaatgaaaaattagccaggtgtggtggcacacacctgtaatcccagctactcaggaggctgaggcacgagaatcactggaacctggggggcagaggttgcagtaagccaagattacaccactgcattccagcctgggcaacagagtgagactctgtctcaaataaataaataaataaatttcaattctggcgtgtgtgtgtgtgtgtgtgtatgaatacacttgacagaagttgtctaaggcctgtacactaaaagatataaaaaaattctgagatacatttaagatctaaataaatggaaagagttattgtgtttgcagattagaagactcattaaaattctctccaaattgacctacagattcaatgtcattcaaatcaaaatcccaacagaaattttcatagaaattgacaagtgggtctaagatttatatgaaaatgccaagggactacaacaaaaaaattctttttaaaaaacacaaattgaggaacttacactactgatatgaatacttttatagttacaataatcaagagactatgatattgatataaagatagacaagtagaacattggaacacaataaaggatccaataataggccagcatgtacatagttgattttcaacaaaaataccacaacaatttgttatgaactgaatatttgtgatctcccctgcaaattcatgtgttgaaatcctaacccccagtgtgatggtattaggaagtaggtctttgaggaagtgattaggtcataaaagtgtagccatcttgaatgggattagttccattcagtgaaaccctagagaactttcttgttctttctgtcatgtgaggacaccacaagaagactgccatctatgaaccaggaagcaggccctcaccagacatgagatcttccagcccctcgatcttagacttcccagccttcagaaccatgagaaataaatttccattgttttagtcacacagtctatggtattttgttatggcagcccaagctaacaaacacaatctcaaaataaatatgctgaaagaaaccggacgacagaaagcagatacggtatgattctgtttacataaaactctagaaaatctatagtaagagaaggcagactagagattgcctggggttgaataggcattgggatgatatattggaaaggtatacagaaaggattaacaaggaacacaaggaatagagacacaaggaaactttggggagtggtgcatatgttctttatcttgattgtgatgatgatttcacatttgtatgaccatgtcaaaaattatcatattggaccttgtaaacatatgtaatttgttatatgcaaagtgtacctcagaaaagtagtttttaagaaggctcaaaacaaaagtagacagagataaatattgaaaaataatcactctgtactatagagaacagaattttttactttctcttaattatggagggtaaactttctcaagcatgcaagggtaacatatgttatgagattatattttctttatctcataagtggcatattttaatgcaataaatagatctatgtcatatataaattaactccagaaaacctgtccattattcagcatttctcagtctggccaaagagtggcagtgttaaaaaagtatttgagtaagattgtacagtgctgaacaaacaggaatccaggtatggcttctgattggtgcaatctcctgcaccaatgagcaaagtaacttctgctggggaagctcattcagtaaaatctgatttaactgtgttttctaaatagctaagggatggagactgttctgcaagtactcctagggatattggggttccaagcagcctgtgagtatgtggttagtctgggagaattgcgagatggtgacagcatcctgagggcaagagtcgagtcatcttctgttctgggaaggcccgtttgagagccagatatgtgttgggaaaaaaaatgacaatactttgttttaatgtgacaattctgctgcctaggggaagtggggagggggagaaaaacatcatccctaccatgaccatgaaaatcttatgagggtcttctgtattttctttacattgtctttttgaacaggggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacacacagcgatcttcaggcctctatcagctgtctccaaacctgcagctgggccacatatgctcttctgacatggggctcctgagatgtggctgggacctttgccaagacatgaagtctcagaacgttgcaattgtcttattggaaaaatggggaggagagtaggaatgatacaagggggagctatatcactaatcccaaatttaatttgactttattgtctggtagttatgttactttttagtagatggaacatcaaattcgaatgagaatagcatgaatttcagtgatttatgcaagaactatgcacgaatattatgtccctgttgtgccaaggaacttctttccctttgctatttacccaccttgttaataaaaagaaattgtgcattgtttgtcagattctttgtcacagattaacattgtaccaagagtgttagaatatccatactgaggagtcatgggcaatagttttttctaagtttgtagtatagatatagaaaaagacaaatgtttagacagataaataggtgatagatagattataggaagctagattattagatagatgataggtagatagatagataataggtagattagatagagtgagctagagagaggggaatatattaataaatatctaatgcagtcttagactggcctccacttctcttctcattgtgctttcattcatattctagtctcagtattcttctggccactccaaattatcagcttaaagaattgtttcccagttgtctcagtatgaagtggagaagatgttaccttcatcctccactccacatcagaatagtgctggcctacagtgggtgtttacaagtattaaactgatactgaataactgataagatcataggttagagagaaataattcacatgtttcttaaaagctatgtgatgttgaccaacaactttaactttacaagtctttattttccctctgtaaagatgatacaatcatattattttattcatatgttcttgttaggatgaagtaaggttatagattacatacattaagtatctggtgtattgcaagccctcaatatttgagatagtatttttactattaatcaaacaatgacaatttcaagtaagtcaaaattctcacataaaagtagggaagttgatcaacatgatatggcttcaacctaactaggagatgttctattctttaaatttagaaaagaaaggaggaatataatggtctcctgtcatcagaaactgcctagtgacctggtttcaaaagaaattgcatgtaaaatgggaatgatcatttatgttggccaaagtcagggaagatttttaaaaatcaagtcgaattagattattttctgttttaaagaaatgttacctataccacccactgggagaaaagtttgctaaaataaacaggaaagagagaaaagagagaagcccatgaaagaaaatgtttggcaacgtgataagaggaaaagcaagcaggaaataagaacataagtttctgattttcatgaaatgttccgagtaaagtgacacttacctatgtgtgtaaatatgcatatacatatacaaatctcaaactaaagagtgtacatatttgcattttaacctaaaatcaaatttttctaattggaaaataatataaagatattgtctccagtagaatgctgggaatattaagggttgaaagtatgaagataagtagtcataaggatgtttagagattaacctgccatgtcccacaaggctggtaaatcaatgttatcaggagaaagaaactgttaaattcacatcagcgtcttaggtcagcctaagcaaataggttatatgacatgcaacttacccttctcctctttttttctcccccatcaaaagccaatttcctattctgagaaaataattcaccttctccagtgattctgcctcagaatgtccagcaaactgaacaaggctgagctccagacattggttttgattctgggcagcagaaatttccctatgggagaagatgccagcatgacttttcctagtgtgcaatgagcagcgaccagctctgtctacctccttagggatagcccctgataggaatgctggggttgagcaagaggaagagtgagtgattagaagaaagaaggcaggaaccgagtttcttttcctcctgccttgagtgcaaggtttagttccttttctaacagctcttggcaattccattataaatcaggtgaaagaattagtctgatttttgtttgtttgtagggcctagcatgtcatagaaagccactaaattctaatcagcaatatctggacagtaagggagattgtgaacttagttttcttacaggacataggtattataattattattgtggtaaaaatttcctcctagcaggaagataatttttttgtgtgctttgggaatcacccaaaagttttccactgcaaaaaccaatggaataaggaactgatattttctaaaccttcagtaagtggctaaatctatcaggcttatctattcacccccatagtgagaattccttgcaatatgtgtttgtggcattcttatagataccacagtcagaaaaaaaggggatggattaaaataagcagaaaaatttgctacattctgtgctaactttaaccccatataaatgctgtcttataagtagatctattaaatagggccatccatagccacagcctttcatattttaagtaaatatcacaacataatattttcatcagaaaacttgtctccaatttctagagccttttgttactcctggcactatcttagtaggactttagtgtgccagatatgagcctgctagatttaagtcaaataatgatttattcttatgccctcttctcaactgtgttgatcaaattcataaaacaaatgttagccttaaattccttacttcacttccttgtcttcacttcctctgggacatagtcttgtcttgtctagtctagtcttatgctgcagccttgacaacttgccaagataaaaagttgagagttacgatagtagaaagaagagctacagagaataaacagaatgagaaagtataaaatatgattaaatggagttccagaaagaggagagaggtgaatgaggcagaaacaatatatgaagagataatggatgaacagtttttaaaaaatggatgaaagacatcaattcacaattcaagaagacaaaaacattcctgggcaatttatataaaaagaagtgtagtgtgtgtgcatgcatgcgtgcatgtgtgtgtgtgtgtgttcagagtaaaacagcagaaaatcttaaatcaagaagaaaatcttaaaaatcaaaggggagggtgaaaaagactgttttcaaagaagtaaactgacagctgacttctcaaaaataacaatggaaaccaactgagatttgaattatttttcaatgttcagagagaaaataactaacatcaaattttgtataaagcagagcaattcttaaaataagaaataaaagcatttaaagaaaatctgcagaatttaacggtatattttctctaaaggaaactccacaagtagatggaaaggatgagggcctggattatactgcacctgccacctgtgtggttgtgctcaaagaacagaacctctttgggatggtttctaaatttcaaaataaagatgaggtattctcagctagtctcactgtattttattaattgaaacaccatatgtgaaacagaagactctaatgcaaacgtaaagagatttgttactaaaaccttaggccaagctttggatgttcttaaaagggcaatggcaggaatgagaatggggaaaatgatctatcctcagtgagttgtaggacttagagaaagcctcaagggctgtcatgtgttttatcatgtcctgagaaacaggtttacaaatattagcacctccttactgtgctggataattctattcggtttcctccagcagtttgtgataccccctatgtgtagagtgggtatgtagggggcaaacaaaggactcatctgttcttgctgccggcaagctgtagccacatccagttggctctcacctcccaaatagcttcaaagagaagcaaatcatattcaacagtttttgtggcagaactcatcctgcagaatttttaaaaaacttgttttatcttatggcctttgataaaagttctgaacccagggccagttgtagcagaatatggacatatgaaaaatctgcctttagtctcttgccattccttcaccattgcctcccacctattctactgctcctgctttttacccagcccctagtagtattctatgatgttttaatactgttagcctgcccaaagcctgatatttctagtcactgaattgctcttcagaaccttctcctacactattgagtagatatatatctctctccactcaatctctaaaataaagtggtttatagcctaacttactctcaatgtaatgttctaggttaggtctccctggactgtttgtatttgaaaaagaggagattccaagaaagtctcctcaaagatacattctcagttacggtggcagtaggatagaaaagatgtttttattgtaaaatactctttcccacacttctcagccatagtgtaggctgccagtgtttggtcagttcccatcagcaggaacacaggcaacatactgttagcaattttttttttttttttttttttttgagaaggagtctcgctctgtcgccaggctggagtgcagtggtgccatctcagctcactgcaatctctgcctcctgggttcaagccattctcctgcatcagcctcctgagtagctgagattacaggcatgtgccaccacacccagctaatttttgtatttttagtagagacagggtttcaccatattggccaggatggtctcgatctctttgtcagcagtttttaaaacatatgtttttattccaattattttagaaagataacataattcagaggaaaaaattaaagattctattgcttgaaaatacatagaacaatattctatttaactacaccttgtctatgtttagatacacaaagactcaccattgttacaattacctagagtattcagtacaataacatcctgtgcaggtttgtagcccatagcctatcgtgtagcaggctataccatctagaccagtacgctcttataatgtttgcacaatggcaaaattgcctaatgatggatttctcagaacgcctgtagttgagcaaggcatgactatatcagtaaaacttctacatgaaagaataggcaggggaactagtttgtctaagaaaacatatgaaaatttaactgtttcagaggcagcacagtcaaaaaagtaaaggtttgtaatcttagatatcactcaaatactagtcctcctacttccaaaccagataaccttgggcatgtgactgaatctttctgaacttagattcatctgaaaaatgaataccatctatttcctagagtggtaaagagtcccatatgctacgggacttaggattgcttaggattgctaaggatagctttggctattcaagctcttttttggtcccatgttaattttagaattgttttttcaaattctgtaaaaatgaagttggagatatatgagataaacaatacacattacctgccacatattaactaatatatataacaaacattatgtaaatgacaaagagtactaggtactcccaggaccttttatgatcctcagaatatttttttgaggtaggtattattatcttgcttttattgatgagtaaactgattttcagagaagttaagtaacttgttcaaagtcatgcaattaagaagtggcagagatgtggtagtttttgtgatagaattcttttcctttccctgcctgttgaacggtctgcatttagacatttctttaaattattttcagtttctttcccttcgtccccacaaagagcactaaaggtcatggtaaggtaggatcatttgaatcatgttatgatcttcctaacatgaatgactcctggcttttccagttaacaggtagtggtccattatgctgtggttatattttctgcatgtatgatgatataacgtaactggccaggcacagtggctcatgcctataatcccagcacttttggaggctgaggcaggcagatcacctgaggtctggagttcaagaccagcctgaacaacatggagaaatgccatctctcctaaaaatacaaaattagctgggtgtggtggcacatgcctgtaatcccagctacttaggaggctgaggcaggagaattacttgaacccaggaggtggaggttgtgctgagccaagatcataccatttcactccagcctgggcaacaagagcaaaactctgtctcaaaaaaaaaaaaaagaaagaaagtaaccaaaagactgtcacttacttgccccatgacccctgttacatagcctttgaacctcagtttgtcatagaaaaatgaagaaaatagtctctcccatcctattgctttttactgtattaaatgtaaatgtatatggttctttaaatgttatgtattattcagatttattacaataattgttatgtaaatgacatctatctgataatagaatgaggtctggagttcaagaccagcttgaccaacacggagaaatgccatctctactaaaaatacaaaattagctgggtgtggtggtgcatgcctgtaatcccagctacttgggaggctgaggaaggagaatcacttgaacccaggaggtggaggttgtagtgagccgagattgcaccatttcactcctgcctgggcaacaagagcaaaactctgtctcaaaaaaaaaaaaaaaagaaagtaaccaaaagactgtcacttatttgccccatgacccctgttacatagcctttgaacctcagtttctcatagaaaaatgaagaatatagtatcttccatcctattgctttttactgtattaaatgttaatgtatatggttctttaaatgttatatattgtttacatttattacaataattgttatgtaaatgacatctatctgataatagacacagcatattactctattaactgcatatacagtaaaaacacagtatagaagattttaagataatctgtgtctatttttgtatcagtgacatgctgtttgggttactatagccttgtagtatagtttggagtcaggtaatgtgatggctttgttctttttgcttatgattgctttggctatttgtgctttttttgtcccatattaattttagaattgtttttttcaaattctgtaaaaatgatgctggtaatttgataggaattacattgtatctgtatattgctttgggtagtaattttaattatattgattgttccaatcagtgagcatgaaacatttttttatttgttgtatcatctatgattcctttcatcagttctttgtagttctccttgtagacatctttcatctctttggttaaatgtattttctaagtattttattatttgtatgtgtggatatcataaatggaattgagttcttgatttttttcttagcttggttgttattggtgtatagaaatgctactaatttttgtatgttgattttgtatcctgaaagtttactgaagtcatttatcaagtctaggcatctttcagaagactgtttagggttttctagatataagatcatgtcatcagtgaatagagataattttagtttctcttttttaatttggatgccttttacttctttctcttgcttgattgctctgcctaggacttctggcactatgttgaatagaagtggtgagagtggacatccttgtcttgttcctgttcttagagggaatgctttcaaattttcctcattgggtatgttgtcatggatgacccttatttgtcatagtttttttttattattttgaggtatgttcctttgatgcctagtttgttgagggtttctatcataaaaggatgttgggttttattgaatgctttttctgcatctattgagatgatcacatggtctttgtttttaattctgtttacatggtgaatcacatttattgatttgcatattttgaacgtagaccaatggaacaaaatagagaacccagaaataaaaccatatacctacaaccaactgatctttgacaaagtcaacaaaaatacacaatgaggaaaggacatccaattcaataaatggtgctggaaaaactggatagccatatacagaagaataaaactgaatgcatatctctcaccatattcaaaaattaagtccagataaaataaagacttacatggaagacctgaaactacaaaaatcctggaagaaaaactaggaaaaactcttctagacattgaactaggcaaaaaaatttatgacaagatctcaaaagcaaatgcaacagaagcaaaaatagacaagcagtacttaattaaactaaatagcttctatacggcaaaagaaataatcaacagcgtaaatagacaacctacaggatgagagaaaatgttttcaaactatcaaccaacaaaggactaatatcctgaatctataaaaaaactcagacaactcaacaagaaaaaaacaaccccattaaaaaatgggcaagggacatgaacagatatttctcataagaagacatacaagcaaccagcaaacatgtgagaaaatgctcaacatcactaatcatcagagaaatgtacatcaaaaccacaatgagataccttctcacatcagtaaaaatggctattattaaaaagtcaaaacacaaacagatgttggcaagaatataggaaaaaaaagaatgcttatacactcttggtgggaatgtaaattagtacatctatggaaaacaatatggagatttctcaagggattacaaatagtactactattcgacccagcaacaccactgctacccaaaggactacaaatagagctaccattcaacccagcaacagcactactacccaaaggaaacaaaattgttatgtcagaaagacacctgctcttgtgtatttatcacagcactatttacaatagtaaagtcatgaaatcaacctaagtgtccatcaatgtattattgtataaagaaaatgtggtatatatacaccgtggactactacacagccataaaaaagaataaaaccatatcttttgcagcaacatggatttagcttgaggccattatcctaagtggaatcactcagaaacagaaaataacgtactgcatggtctcacttataactgggagctaaacaatgggcactcatgggcatatagagggaaataatagacagtggagattccaaaagggggaatgatgggagggttgaaaaattacctattcagtacaatgttcaccattcgggtgatgggtacactagaagcccagacctcaccattatgcaatatatccatataacaaacctgcacacaaatgacctgcatcgtagtaacagtaataataaatatcaaaattatatgcttgtctagggcacttacaatgaatggggcttgcaggactggaaggtgctctgtgtaattcagcaagtgagtaagaggtcagtgaatgtaaaagcctaggacaatattatacactgctgtagactttataaacactatatacttaggctacagtaaatttgtttaacaataatttcattttctcaagaataagttaaccttaccttactgtagctttttttactttataaacttttaatttttttaactttttgtctctttcataatagcttgaaacacaaacacattgtatagctatacaaaacaattttcttttttatatccttatttatatccttttttatatccttattcttttttaatttttttttctattatttaaacttctgtactaaaaactaagacacaaacacacatattagcctaggcctacacagagtcaggatcatcagtattgatgtcttccacctgcacatcttgtcccactggaaggtcttcaggggcaataacatgcatcagctgtcatcttctatgatagcaatgtctttttctggaatacctcctgaaggacctacctgaggctgttttacagttcagttctttataagtagaaggaatatactctaaaataactattaaaagtatagtatggtaaacacacaaacaggtattaccgtttattactatcatcaagtactatgaactgcacataattgtatgtactatacttttatatgattagcagtgcagtaggtttgtttacaccaacaacaccacaaacatgtgagtaatgcatttgtgctacgattttacaatggctataatgtcactaggtgatagcaatttttcagctccattataatattatgggagcactgtcataaattgttgatggaaataccattatatggtgcgtgactgtataataaaacctgttccagtttgaaccattggccagagacaccaacagacacaatgtaatcaagatgtagaccccaatgtcagccttctagacacaaatgaaacaacacccaacttagctcaagaacactttctaaaagcaggaggctccagttccccaatctgtgggaacaaggagaaccacagtaagtgaagaggaaaatcattatctctgaacttgtcagaagaaaaatcccatcaaggaatgcttttgagaacttgaattctagggaagcccactggaggccacagccactacagaaatatagaggccacagcttcctgacatgcggtgaggccacatctccactcacttcctgtcagtaggtgtcacttgaacaaattttctcatgtcctggccagtcacctggagcctggaggcatgtcttactttgcatacacctctgtcaaaatgcgtatcagacaattatgttataaattgaatgtcttaggtgttacagagtaggtgttgtggaatgaatatttgtgtatcctccaaagcgcactctctctttctctcacacacacacacatacataccccaaggaaaggccatgtgatatctcgattttaaacttccagcctccagaactgtgagataacaaatttctcttcgttaagccactcagtgagtggtatattgttatggcagcccaagtagactaatacattaggttattctgctactgacccaccttactgagctagacctactttggtccccacatgtctccccagggacactgtacgaagcctggagctatgtcagtttttctgtactcaaaagtagtgccctcctatatttacctcttgtttgttttattggagttcctggcaggtatctcccttctctttgaactgtaaatagaaataatccttctttttgaagtaggattttctttctgaacaagcttataatttcctaccattgatcttcttgcatggcaatttcaattaaaaaatcatttgaataattatgttagaatacacagcaactatatttcttaggttagtgtagtttgcaaacaaaaggcatatatgttttcctagtaaccgcaatgtgtgtgtgtgtgtgtgtgtgtgtgtgtgtgtgtgtgtgttttaatttccctacaaatcactgctaacagccaaggaaagcgaggctatattctggaaggcctgggagatatagtcccctgtatgtgtatgaaatctgtttggaatctcatgtactatatttaaaattcatttgttactttctattatgtaatatattctcatttgtttcaacatacaaaaaatactttaaatcgattatttaaatgtatgtcatgttcatcccagagcttaatgtcacccttcatacattcatacactactacttggcttattcttcttgaggagagagaaatgtattgccagtattctcaataggtacactttcaaggctgagacagcagggctcatgaagaactggaacaatataaaccattgccgagactgcaacagcaaccatgatgatctcaaggaggcgacagatctaatggtaatgggaaaacacacccttgaggaatcagtgagcccctgcagctccctgtcatctctgtgcctcccacattccattaagagaatatagaaggaatgcatttttcatctgaattaaggtgttttgctttctgtttattgtttctttattttccaaaaatatgtttttcaataaaatctggcagtgattaaaaagaaaaaaagcaacataagattgtatttttatttggtggaaagcagcaattcattttaggtaacatgccaccacataacaggaatagagaaggtaagaaaggtaaatatacatacagaagtaagtcatgggcaaacctaaacaactaagaaaaaattagcaatgaaattaaaaggagaaaaatgcccagggaggcagaaatagattttcctgctctcctacgtctaaagagcacaatgagatacaaaacacaaatgccagtagatggcagaagctatttacctaaatcaggattgaggctatgaggcatagcttagacactcagtccagatcctaggcatttgaaactccaagttgcagaatcaattttgatcttaaaaaccaaacttcttcaaaattcccttctgtaaaagtgaggtttgctactattcaaagttttatttgcttcttaaagaatagccagaatgttcctaccactgtgttgataagcaaaggtaacattgcctctatcaggggctttttctcttttatttaagtctctgccttttatgtcaagggattcttttaatgtctaatgatcctgggatgctcattcatacttagtaggatacaaatctgagattcaagcaaagaaaaatggctccagttcctgtttttaaatacttcttcacttcactctcaactaagcctgatagcccagaatttcatgttatttattcaatatcttcagaaaaatagtcttttttccacaaaagtggttggaaaggagtggacacctgactattccaggtcaaatgggaaatctgagagtataactgcaatttattcaattttactttgcattttctctataaagtctcctacccctaccctctctctgattttctgaggtaccaggtatcctactcactaagacttctggtgcacctgaatttttgttggcatttgcttctgtgggaccttagaatttgcctttcttcagttcatttaagtcagttaccacttgttcattcacctgcattttccaaaacatctcacatgctgttatcctttgcctgttctatgtgtcctttggggttcataacttttaaaaacatttttactctcatttcaccaggtactcagaaaggaatagagaagtatgtttccaattcaccatacttaattatcagtctagccttcactgatatttcagagcaattataaggtgcccaggggcagagtttccatctgtcttgttcatgtctccatatttctctaatatatagtgaatactcattaagtgtgttcatcaagtgaaacggagaaatagaagaaactgaaaaagtggcatgaaaggacaaaaatttagcatttcaccatatgggggcagtgtctctattcatagctaaccttcaaggttagctcaaaaccctgggaaaacatctggtaagagatccgattggctgatatctggaacagagatttaaatttcgtggtagtgtttttagtgtcactctaagcccaagagagtttcttgaagcaaaaaaaaaaaaaaaaaaaaaacccattcaggaaataattctttgctgataaggatgctccttgaacatttattaataatcttgtggatgcagctgacatgtgagtcttgagagtttctgactcttccatagcgaattctaaagggaaggaaattctgtgagggcaggaggtgaggctttatcagagactatgaaaagaggaaaacagaaggaaaaaagctagagaaggagggaggaaaggaaagacacagatgcaaggctgggaagtttggtgatatagtgtccaacacagctctgaaaaaggtgatctaaagataaccttaaccaccttcttttctctttctaaacaggggtcagtggtcaacagctgaatcagagtcctcaatctatgtttacccaggaaggagaagatgtctccatgaactgcacttcttcaagcatatttaacacctgactatggtacaagcaggaccctggggaaggtcctgtcctcttgatagccttatataaggctggtgaattgacctcaaatggaagactgactgctcagtttggtataaccagaaaggacagcttcctgaatatctcagcatccatacctagtgatgtaggcatctacttctgtgctgggcagcacagtgctccccaaacacctgcagcctgtactcaaacttgcagctggaactctagtctctatgctgccttcagctcttagtcctcttggcatgaaatgtgattatgcatgccacctttgccactgccattctgtcaccacaaactctcctttatccaaggatttgtcctccaaagattgtgctctttgcttgatgaacttgcccctctcaattcatttttagtgtatgtaatagattttcttagttatttctgccacgatatgaggagaattgatcaacacacagttacagtagaagattttaataagtatctcttttaaaatggatgatatcaataaagtaaaaatgagagtccagaaataaatccataaatctatagccaatttattccaacaagatcattcaatgggaaaagaatagtcttttcgacaagtggtgctgggaccactggatagccacagttggatctctacttcacatatgtacaaaagttaactcaaatggattaaagacctaaatgtaagatctagaagtacaaacacttagatgaaaacatagttgtaaatcttggccaccttggactatgcaacaatctcttatatacaacatcaaaaaaagcaactgaaggaaaaatagataaattgggcattatcagaatttaaatctttgtgcatcaaaattcgcaaaatattccacaaaggaaaatgaaaagataacccacataatagaagaatatatttgcaagtcatgtttatctgataaggatctaatatcaagaatatatattttaaactcttacaatttaacactaagacaaatgccaattttaaaacggtcaaatgatttaaaccatcattgctccaaagaagacacacaaatggccaaaaagcatgaaaaaaaagatgctcaacattattattcattgggaaaatgcaaattaaaccacaatgagctgccacatcacacccactaggatgttcataatttttcaaaaaggaagaataagaaagagaaatgtaaaattctaagtgttggtaaggacgtggggaaattggaatcctcatccaccactggtaggaatgtaaaatagtacagacacattagaaaatagtttggcaatttctcaaatgactaaacacagagttaccatttgacccagcaataatagtcctaaatatctacttaagaggtcgaacatgtgatttatttcattggccagaaccacatcatatggccagtactaattgcaagggaggtagagaaagggagcatttaatttgtctagcctctaaaaaagacatgagcatgaaagatgtcaattgcagataaaagtgttggtttaactatccaaaaacatctgccacatcatactaggtcctcattccccagaagagactctgatgatacatcttgatattcttattactgttattaccctaacagcatgtgccaaaggaagctgaagtctgttaagagctctacagagctcttcaaatgtagtattgtttttgctccaaaaaatatactgtaggttttcttccttgcaactgtcctgtgggaaatcaatatctctcaagaggcatcagctgatgtttcagaggaatgatggtccactgcccctgatactgatatgcgcagttccaggcagttcttaaagctagtcgctttaacgcctcacagagatcatcatgttcttaaacatcgatacggaattcacttccatctccctgagaagcagtcccctgaagacccagcacaatatttccgtgggtcccacatgtgcatatgacataaccctcaaaatcctagggatgttttaattgaggtaatacttttacagctatttataggatctctagcacaattcttttctcaggaacttaaaaaatgggtattagctaaccatgagtaaccatgtttccttctcccttccccattcccattcagctgtatgtaggcaaatctaccatcccaactttctcgatgttgaagctatgatttattttatagcaggctttctattttattttatttttaaacttttattttaggttcaggaatacatatgcaagtttgttatgtaggtaacctgcatgccacgggggtttggtgtatggattatttcatcacccaggtaataagcatagtacctgacatgtttttcaatactcaccttcctcccacccttcatcctcaagaaagcctgggtgtctgttgttcccttcttcgtgtccatgtgtactcaatgtttagctcccgcatagaagtgagaacatgtgatatttggttttctttcccgtgttaatttgtttagaataatggccttcagctccatccatgttgctgcaaaggatgtgatctcattctttcttatggctgtgtagcattccatggtgtatatgtatcacattttctttatccagtctaccattgttgggcatttaggttgactccatgtcttcgttagtgtgaatagtgctgtgatgaacataggtgtgcatatgtctttatggtagaaaaatttatattcctttaggtatatacccaacaatgagattgctgggtcaaataataattctatagaaggctttttaaagtgtgggctagtattgaaggtaaagattgccttattcagttctgtatgctcctctgttcctggcacaaagaagacagtcaattaaaaatgtttacatgagaggccgggcacagtggctcatgcctgtaatcccagcactttgggaggccgaggcgggcagatcacaaggtcaggagttcaagaccatcctggccaacatggtgaaaccccgtctctactaaaaatataaaaaaaaaattagctgggcgtgatgatgcgcacctatagtcccagctacttgggagactgaggcaggagaatcacttgaatccaggaggcagaggttgcagtgagccgagatcacaccactgcactccagcctggtgacagagcaagactctgtctcaaaaaaaaaaaaaagttacatcaattaaggggcaagatgctaattaattctcatatctgtgcctctgtgccacccagaaatgcagaaggaagcttataaacaaaaaacagtgggttaaattatctgaccttcatggggacagtacaaactatattcataagcagtaatagaacatggcattatttactttattgtggtgttgtcacatcatcagtctcttacttcatgtttctgggttttgtttcttgcttaagatctagagaattaggccactttatcattgtcacaaaaaaagtagtcttggaaaccaagcgatccatcacttcctctcaactgggcaattcagcttttctggaatgcaaatatgtttgtcttcaccttgagatttgaactttctaattagtaattctttttcttagtgatcataaagatcaagcaagaaagtactagtcttcctagacttgaacactacctacatagattatatgtattttactaaaaatagacattcctagacgatgacaagaaaactatgtaataacatttatggaatggaatgcaaccaaagctatactccaagtatactagcgaaggccaaactattctaacaaatatatgccaaacgttcagaggcttaatgaacaaagtttgtctttcttgtgaaaatctggagcagatattccaggtcagcagatgactctgccttacatgatctttgaggaactgaggttattctcatttggggactctgctatttctcagagacttaccatcatatgcagggtcatggcctggctatgccaggtttcacttagcaaggagatgaacgagtgggtatggagcaggcatgaccattcccttaagaatcatggacaagaaataatagaattactgactcctaagattatggacagctttgggtagcctgtccttcaatggtaagacaattttagaagtatctaccatctttcataaaacatgtggacactagttttcagctattctgcaccagctcacaagatggcggtgttctattttgaatgacttccatgggtgattgagtgggagggatttgaatttaaatagaaccaaatgacactttttttaatggttggctgaattgccaaattgctatttccctttttctgagtgtgtgtctgtgtccgtgtgtgtgcatgtgtgtgtgcacgcacgcgcacacaggcagacgctaggggtagagtgtgatggttcaaaaagaaaaggaaacgcttaaaggtagtgaatcacgttttgcccaggaaaacacacttgataactgaaggatgatgaagtgtccacaggctttactagctatcttttggcttctactgagctgtaagtagggttactacaaagggtcaggggcaaccaggaaacctgaggattgatcctcagaacactaaaagggtaaagtagacttcgttctgacttattgtctgggagccctgtggttccaacggtgaataattatcacatttttctacacaggggtgagcagtgaagacaaggtggtacaaagccctctatctctggttgtccacgagggagacaccgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaacttttcagcatcctgaacatcacagccacccagaccggagactcggccatctacctctgtgctgtggaggcacagtgctccctagtcacctgcagcctgtactcaaattctacagctgaggctctgcaactgtaagatggggaacttgctacattgagcaagccctcaaaaataaactatacggaaaagcagttattggtcaaaatccttgtgcctatgttgacaattacttttgcagtttactgaatcctaactcagagtcatatcgctgcattcactactttctctgtgagttttctatgggattcagcatagctaatatttctagagggtcactcaggatactaactccattgccacaccattatgctctgtggtagaaagcaagcccttttatcaggattgtacaggcaactgatatgtgcactacacattagggaatctacctaacagctatggatgttttagcttctttcccaggacaggcacatttataggtaaagttctgcctataacatttttttctggacctactagcaaagaacaaagggtaggaacaagcaggtatcattacctgattaaaacaaaaggttttcattctcagttgcattattcttacttactatcttcattttaggattgttgcctatgctaggtacttcattaaagtggtgatagaatttttcaagatattacacattaatttgtgtacttagaaccttaagcagcctacgaaaagaaaggagttagttgaagtaagttatgtgaagctaacataaacttagcctacttatgttgtgatacactctttcaatgaattatgtaatcatatgtatggtatttacaaagagcttgcaatggaagctaccatttattgaaagcaagtattatgtaccttgtattttgcaaatatcatctcattgaattctcaaaatcactttgataaatcatcaatattactttctgttaacatattaggaaatgcagactcagaaagattaagcccccttccccacctcctaccccagacaaataactataacagaatctgaaatcaggtctatgactccaaactatactttgtctattacatgccctgatgttaaacatcactgaggagaaaatttacccacagtgtgaccacaattatgtgtaaaaaatgtacacaaaatacgaaaataatgtgttcaacatgtaaataaaataacatttgcaataatatgtgaataaaataactccaaaagtttgcaacagtattagttatctttgaatactgaacttaatactgttcattgttttactcctttataatattctttatttttcagattatctactatgaactcaatactattattatttcagaaagaaaaatatacattttaaaataccaaaatccaagtaggctgaactgcattatatgataattatctgacactcacagtagcttaattacaatgaggaatagacatgactatacatagccaaatgatacagcattaaaacaagatttttgattgctagctcttcaaatcactgtagactagtgctctcttcaattgggaatgttttaaaattacaagaagacctatttctcctgagaatttatttgaatgactgtcctatgggtagaatgctttaatatcccatctctgtgtaggagaggacaggcagtaaaggccacccgtgcttgtgagttcattagacaattcattgcaaattgggcatggtttaggtttcactgtctgggaaatggggagatagcctgagaaaagggcaggtaaacattcaaagaggaggggaagaaacagtataaaaattaatagaatgtatcctgccatttttagcctgcacagtcttctgtccattttcctttctcctttctatctgcatcaaaacccagaaatcacacagtggatataagaggaaactctgacagtcatttatttaagactgaaaaatagagcgggaaaccctatgcaagatgcccagtgtgtctggctctgcggtgtgaagagtttatgatttagaagccagagatttagctgtctttgatgggaatgtgcagttggaagggggaagtttcttttttcactctttattgtttcctatcctaatgagaaccaaacaatttacatctcaaaagatcaacctgtcaccaaaataacatgtattttaatgctaagactaaatatccatttgttataaaagaaaaaacaaattaaaaaaaatttataacctcaacctacagacattaccactattaactatttagcattttgctttccatttcacctgtatcaatgaacatgaaaaaataagtctgtagagatgtggggaattcaacttatttcaaacaaagagtgtttctcaaagtcactgcaaaaataggtgtttctgttccttaaaaaaatctacatggttaagatcctcccacttttgacctgtgagttgtgataaaaagcttccagaaaactcatctcagtgacttgattatgaaatgctaccagtttgaagcagtcactgaaaaacataaggtcataaatcaggaatccagaagaaacaatgaatagcaactttatcttcacttcacttctaacactggctctccaaggtaacagccctatcctgtacccagagtggcccttctggagaaggtggctggtttgacctatgactgttgagtgttttacattacagggtctgggagagcagactggatcaagccccaggagacagaagtatctggaacagaagggaagactgtgaacctactttgtaactatggtacatcatcggggagctatcttgatctctgctggttttgacagtatccgagccaggcatcagaatacattctctacagagggtggggatattctggaaaaggagatgccagttttgccataggaaagtttattcaaagagtacagcaaatgcaataaatgtgtacattagaaatctggttcctgcagacactgccttatattactgtgtgctgagatgcacaaaaagaacactttctaggggtgtcatacaaaaacaccagcgcacaggaggaaggagagcatttgttataaccacactgatttttttttttttttttttttgcaaaggcgtcattgtaagtggaagacactggatcaggagaattctgctttaataatagctatatatagtaatttgtaggcaaatagcttgagcttttagagtttccatttcctgaaattagatagcaattctaatttgtaagcttttatgagacatggttttaacacttggattaagtgcctagcatgtcctacatgctcagcaaatggcaaatatcttttcttgctctccctctctgtctaactactttgacctcaaaggacccttctttcactatctgagaatcttctatatactcctactggtaaaataataacaacaataacaataataataataataaccctaaaaacatacatgcaagacctagatagagaaggcttctttgcccagggatcaatggtcattgtgccaggattttaaaagtgtatgctcagcaaatccaacaatcagaggacaaaaggaccccgagacactagctcctgagttcatagaccagggcagttgggcatttatcgtgatctgaacaagaacaggagagagttcctcacaagactaaagagaagagaaagacatttagcattaggtgggtggtgggagagaagagagaaattcttgggaagactacagccatgttctggtgtcagatctgacctccctagatggagaagagaggccaagtgaggcagtgggtcctcagcccacctggtagaggaagagggcacctgccacttcctgcactggttcaaactacactcctaacagaatcctatcatttaatctggatgtgagcaaagcctagcatctttgtttggactggtgatagatgaaaggtaaaagaggaaggaagatttaatttagagccttattcaatagtctgcagcagcactagcaccttactgcttgcaggccggaaacctcaaggtctagcagttcacagtgaagcctgcaccacactggctgctgagtaactgccccagtcactaggagggcttggaaatcagacagcaaatgacaccttaaaaaatatgtataaggccattcttgcactgttataaagaaatacctgagactgtgtaatttataaagaaaagaggtttaattggctcatggttctgcaggttttacaggaagcatggtgctggcatctggttggcttctcagaaggccccaggaagcttataatcatggtggaaggcaaagggggagcaggcatgtcacatggccagagcaggagcaaatgagagagagtgagggggaagatgcaacacactttatttaaaccagatcttgtgagaactcactcactaaagcaaagacagcaccaagccataagggatcccacctccatgatacaaacacctccccccaggccccacctctagcactgaggaatacaattcaacatgatttggatggggacaaatatccaaactatatcattccactcttgatccctcctaagtctcatctccttctcacattgcaaaacacaatcataccttcccaatagtcctccaaagttttaacaaattccagaattaactcaaaagtcccaagtctcatctgagacaagtcaagcttttccaccaatgagtctgtaaagtcaaaaacaagttatttactcccaagatataatgtgagtatacacattgggtcaacattcccatttcgaaagggagaaattggccaaaagaaggggccacaggtctcatacaagttcaaaacccagcaaggcagccattaaatcttaaagctccaagataatctccttagactccatgtctcacatccaggacacactggttcaagaggtgggctcccaaggcgttgggcaactccacctctgtggctttgcagggtgccacccccacagcttctctcataggttgttgagtgtctggcttttccagacacagggtgcaagctgccagtggatgtactattctgggatctggaagatggtgacccctttcccacagctctactaggcagtgcttcagtgaggattctgtgtggggcctccaactcctatttcccctccacactgccctagtagaggttatttgtgggggctctccccatgcagcagtcttctgccttggcacccaggctttctcatacatcctttgaatctaggtggaggctgccaagcctctttcactcttacattgtgtgtgcctgcaggcttaacaccacatggaagctgcccagagttatggcttgcaccctccaaagtggcagcctgagatgtacctgggcccctttgggtcatagccagagtggccaggatgtggggagcagtgtcttgaggctgtgcagggcagcagagtcctggacctggcccctgaaaccattctctcctcctaggcctcaaggcctgtgatgggaggggctgctgcaaacatctctgaaatgcctttgaagccttttccccattgtcttggctatctggctgtcttttagttatgcaaatatctctggcaagcagttgctttgaggcttgcttgaattcctttcctgaaaaatctttttctttctctcccacatggctaggctacaaattttccaaacttttacactctgctttttaaaatacaagttctagctttaagccatttctttgctactgcatctgagcataggttattagaagcagccaggtcacctcttgaatgcttcactgcttagaaattgcttccaccagatatactaaattatcactctgaagttcaaacttccacaaatccctagggcaggggcacaatgcagccaagtttgttgctaaggaatagcatgggtgacattcgctccaattgccaataagttcctcatttccatctgaaatttcatcagcctggccttcattgcccatatcactatcagcattttggtcacaatcatttaaccagtctctaagaggttccaaattttcgctcatcttcctgtcttctgagccctccaaatttctcagacctctgcctgttacctggttccaaagctgcttccacattttcaggtatctttatagtaatgccccacttctcagtaccaatttgctttattaggcctttcatgcaccactataaagaaatacctgaaacttggtaatttatttaaaaaaaaggtttaattggcttatggctcttcaggctttacaggaagcatggtgctggcatctggggaggcctaaggaagctttcaatcatgacagaaggcaaaaggggagcaggcatgtcacatggccagaacagacacaagacagagagagtgagggggaggagccacacacttttaaatgactagatcttgtgagaactcactcactattgcaaagacagcaccaagtcatgagggatctgccctcatgatccacatatttccccccaggccccacctccaccattggggattataattcaacataagatgtgggttgggacaaatatgcaaataatatcacaataatttcttttataaaaaagtgaaaaatacttttattagagaataattttcaaagatctgtttaaaactaacttttaaaaacaatgaactatgggaaacattcactaatgcataaaataaaatatgtaatctttttcattttcagtttgtgcaaagttattttcacaccctgctggtagcaacacaatatattggtacaatcttttacacagtgaattacttggaaagggattttgagattcattaaacagttcatgcctttgaactgtttgaaactgaatgaacacctttgatccatttctcagaatttatattaaagattgattttaagtagaaaaaaccctctaggcaagaaaatagtaaaaatttctcaaccagttagaggaatttggatggcaacttgactgaatactttacaactatttaatgagttaataatactaaaaacatagtaatgctcttgacatacagttagagaaaacatagagttcctataataaccatatgctcacactaatatcgaatgaatgaagcacatagataaaaactggaagttttgatgcaaaactgaaagtatgaaattatttagtgtatgtacttgcaatattttaatttttatttttttcatggaataactgtgaacttgtgcctacaataaataacattttaaaaattctcttgactccaaatgttgtagctagtggaaaaacaaacaaacaaggatctcaaccccagctctgtgcctcagctgtttctcctttcttcaactctggggcatcaattttctggttcccttcccttaactaagtcctcttcttcattattccccaagacctgctgacagaaactctgctgaaatattatttgtgtctcaaacctatctttgatatgggcaaataaggaaaaaactattttcagttcttttctattttctctgcagtagactcagtagctagaagattgagctgattgtaccaaaaattaagaattcttcattgacatcacatgggaaaaccatctctggttttccaagaaggaagattaggtaaggctatataccttgtcattttttttaagttggaacattaaagataaagcttaagtcctctctgctcatgttttcatctgttctcttttcccagagctaaatgttgctctgggtttgtgaaaggaaattaaatcttgggaccccaaactcattgagccaaagggaaaagttaagctgcgaactgggccatgcaaacctgccttgccctttcagttcctacataagatggctacaagatgaaaagctacatgactccaccatattttgcccacaaggaaattcctagtgagctgcaagatctttaccctatagtgtctctgttaaaatttcaccttggaaggccgggtgcggtggctcatgcctgtaatcccagcactttgggaggccgaggtgggtggatcacgaggtcaggagactgagaccatcctggctaacgtggtgaaaccccatctctactggaaatacaaaaaattagccaggcatgtggcgggcgcctgtagtcccagctactcgggggctgaggcaggagaatggtgtgaacctgggaggcggagcttgcagtgagccaagatcgtgccactgcactccagcctgggcaacagagtgagactctatctcaaaaaaaacaaaaaacaaaaaaaaatttcgccttggcaatgtaaactgatagcttattatctttacaggtgcagtcaacccctgtccaccagacataaatacacatctgattgttcccctgccccattttgcctatgttatcttgtgtaaaaatgcaaattccctgcatttttcctctgccccatttatctatgtcatcttatacaaaaaaaaaaaagcagattcactaagccagacaaaggcatgaataactatttttccctacccttctcttacctaaaaattgtatacttctcaatatcccaccctttcccctttaaatctggagccctcaaaatcatcttcggagaaagtcatagacctgtctcctgggcacacatccttaactttggcaaacaaacctaaaatgattgagacttgtctcaccatttttctcaattgacacgtttataatttacattttaaattctttatctttattaatacgcacatataaatgtacatactcatgggaaatataaactatgattttatggcattttttaactaaatgttacatatgatatgtttttctccacaatttcctttcattttactcaacaaaatagacttgaagactagccaggttgatagagatcatctcatttccttttaattcatgtaaagtaaatcattctatcaatatgctatatttaataatactgatagtaataatattatttctccacaaagtagacaactaaggttcagaaagattaatttgccaaggtcacataattagtaagtggcagaatgaaagacaaatcaaatcttctgactttagaaagttcttctgtctttctcatttccaacatgtttagtggcaagagaaaggttttcttcacagaaacctaatatcccaagcaaatttgtatgtaggatttctcttgaaaattacctctcacttggctctgttcttatggctattaggcaataaatactaataataaaaataaaaataacaaaaacccctctctcccatattttggaaatttttcaatgcaacacaatggtcaatgttgttcattttttccctcatttctttgtctccaaccaaagaagcatatctctattttaattactcaacagtggggaatcaaactgattgggatataaacctaggcatttgagctggcaatggctaccctctttgggtcccctccctttgtatgggtgctctgttttcactctatttcactctattaaatcttgcaactgcactcttctggtccatgcttgttatggcttgagctgagctttcgctcaccatccaccactgctgtttgccaccatcgcagacctgctgctgacttccatccctccagatctggcagggtgtctgctgtgctcctgatccagcaaggcgcccattgccactcccaattgggctaaaggcttgccattgttcctgcacagctaagtgtctgggttcatcctaatcgagctgaagagtagtcactgggttccacagttctcttccatgacccatggcttctaatagagctataacactcaccgcatggcccaagattccattccttggaatctgtgagaccaagaaccccaggtcagagaacacgaggcttgccaccatcttggaagtggcctgccgccactttggaagtggcccaccacaatcttgggagctctagaagcaaggacccccggtaacattttggtgaccatgaagggacctccaaagtagtggtaatattggaccactttcactcactattctgtcctatccttccttagaattggaggaaaatactgggcacctgtctgccagttaaaaatggttagcgtggccaccggacttaagattcaggtgtgaggctatctggggaagagctttctaacaacccccaacccttctgggttggggacgttggtctgcctggagccagctcccactttcaactttcttggggaagtggaggactgactagaggcagaaagctctcatccagaactcccagcagtagccggttgagaccatggcgcagccagaagtctctagtcaacagtcgcccatacctcctgggtcccgaccacaactttcttgaaagtgtagccccaaaattctccttacctctgaatctacttcctctgatccctgcctcctaggtactaatggttcagactttcatttcctctagcaagttgtatctccaaagggatctaaggaagctctacactgtgtccttaggcacttaggctataacccagggagtcttatccctggtgtccctcccaatttaggtatacggctctcaacatgggctgttatgtgggacacattccccaccacccttgtcagggccccaagtttgtaatggctaagagagagagacagagagaagacagagagagagagagatggagagagagagagacaaagatggagagagagacaaagagggagtcaaagagaaaaagatagaaatagaaaaagaaaagtgtgccctgttcctttaaaagccagggtaaatttaaaacctgtaattgataattgaaggtcttgtccatgaccctataacactccaatacttttttatttacactttgttgtcagtgtaaataagggcttagcccgaaagcactgaggccactgacaacctgtagctttcctatcaaaaatccttaacccagtaacccacggatgggccaaatgcattcagtcagtaccggcaactgctttgctaaaagcagaaaagtaacttttagaggaaacctcattgtgagcacacctcaccagttcagaattattctaagtcaaaaaagcaaaaaggtagcttactaactcaaaaatcttaaagtatggggctattctgttagaaaagggtaatgtaactccaacctctgataattcccttaacctagcagatttcctaacaggggatttaaatcttaattaccatacaaaggtccgaccagacctaggaagaactcccttcaggacaggatgatagatggttcctcccaagtgactgaggaaaaaaccacaatgggtattcagtaattgataaggagactcttgcggaagcagagttagaaaaattgcccaatagttggtctcctcaaatgtgcgagctgtttgcactcagccaagccttaaagtaattacagaatcaaaagactatctcaatcctgactcaaaaggttacctacaccctctctgaaatgaatttgcataagaactgttgtttatgggaatgcatcttgatggggcagctgggttgttatgaaatactcaggaaactagcccagatctaggactcacccctgagagcaaaggcaatgttgggcatgctggtaaaggaccgctagaatccagcagccaggaccactttctttgtggtcaagaaaggtgggaaaacaggtgcaggactgctacactggtaagcataactaatccgataagcagaggtccatgggtggttacgcaccctggaaaggaataagcattaggactatagaggacactctaggactaatgctcatcggaaaatgactaggggtactggcatccctatgttcttttttcagatgggaaatgttccccccaaggcagaaatgcccctaagatgtattctggagaaatgggaccaatctgaccatcagacactaagaaagaaatgacttatattcttctgcagtaccacctggccacgatatcttcttcaaggggcagaaacctggcctcctgagggaagtataaattataacaccatcttacagctagacctcttttgtagaaaagaaggcaaatggagtgaagtgccatatgtacaaactttcttttcattaagagataactcccaattatgtaaaaagtgtgatttatgccctacaggaagccctcagagtctacctccctaccccagcaagaccccaactccttctccaactaataaggaccccccttcaacccaaatggtccaaaaggagatagacaaaggggtaaacaatgaaccaaagagtgccaatattacacgattatactcgctccaagcagtgggaggagaatttggcccagccagcgtgcatgtacctttttctctctcagatttaaagcaaattaaaatagacctaggtaaattctcagataaccctgatggctatattgatgttttactagggttaggacaatcctttgatctgacatggagagatataatgttactgctaaatcagacactaaccccaaatgaaaaaagtgctgccataacagcagcctgagagtttggcgaactctggtatctcagtcaggtcaatgataggatgacaacagatgaaagagaatgattccccacaggccagcaggcagttcccagtgtagaccctcattaggacacagaatcagaacttggagattggtgccacagacatttgctaacttgcgtgctagaaggactaaggaaaactaggaagaagcccatgaattattcaatgatgtcccctataacacagggaaaggaagaaaatcctactgcctttctggagagactaagggaaggattgaggaagcatacctccctgtcacctgactctattaaaggccaactaatcttaaaggataagtttatcactcagtcagctgcagacattaagaaaaaacttcaaaagtatgccttaggcccagagcaaaacttagaaaccctactgaacttggcaacctcagttttttataatagagatcaggaagagcaggggaatgggacaaatgggataaaaaaaaaaaaaaggtgactgctttagtcgtggccctcaggcaaatggactttggaggctccagaaaagggaaaagctgagcaaattgaatgcctaacagggcttgcttctagtgtggtctacaaggacactttaaaaaagattgtccaagtagaaacaagctgcccccttgtccatgccccttatgtcaagggaatcactggaaggccaactgccccaggagatgaaggtcctctgagtcagaagccactaaccagataatccagcagcaggactgaggatgcccagggcaagcgccagcccatgccatcaccctcacagagccctgggtatgcttgaccattgagggccaggaggttcactgtctcttggacactggtgtggccttctcagtcttactctcctgtcctggacaactgtccttcagatctgtcactatccgaggggtcctaggacagccagtcactagatacttctcccagccactgagttgtgactggggaactttactcttttcacatgcttttctaattatgcgtgaaagccccactcccttgttagggagagacattctagcaaaagcatgggccattatacacctgaacatagcagaaggaacacccatttgttgtcccctgcttgagaaaggaattaatcctgaagtctaagcaacagaaggacaatatagacgagcaaagaatgcccatcctgttcaagttaaactaaaggattccgcctcctttccctaccaaaggcagtacccccttagacccaaggcccaacaaggactccaaaaaactgttaaggacctaaaagcccaaggcctagtaaaaccatgcagtagcccctgcagtactccaactgtaggagtacagaaacccaacggacagtggaggttagtgcaaaatctcaggattatcaatgagactgttgttcctctatacccagctgaacctaacccttatactctgctttcccaaataccagaggaagcagagtggtatatagtcctggaccttaaggatgccttcttctgcatccctgtacatcctgattcccaattcctgtttgcctttgaagatccttcaaactcaacgtctcaactcacctggactgttttacgccaagggttcagggatagcccccatctatttggccaggcattagcccaagatttgagccaattctcatacctggacactcttgtcctttggtatgtggatgatttacttttagccacctgttcagaaaccttgtgccatcaagccacccaagtgctcttaaatttcctcaccacctgtggctacaaggtttccaaaccaaaggctcagctctgctcacagcaggttaaatacttagggctaaaattatccaaaggcttgagggccctcagtgaggaacacatccagcctatactggcttatcctcttcccaaaaccctaaagcaactaagagggttccttggcataacaggtttctaccgaatgtggattcccaggtacagcaaaataggcagatcattatatacactaattaaagaaactcagaaagccaatacccatttagtaagatggacacctgaagcagaagcagctttccaggccctaaagagggccctaacccaagccccagtgttaagcttgccaaggggcaagacttttctttatatgtcacagaaaaaacaggaatagctctaggagccatcacacaagtctgagggactagcttgcaacccgtggcatacctgagtaaagaaattgatgtagtagcaaaggattggcttcattgtttacaggtagtggtggcagtagcagtcttagtgtctgaagtggttaaaatgatacagggaagagatcttactgtgtggacatctcatgatgtgaatgccatactcactgctaaaggagacttgtggctgtcagacaaccgtttacttaaatatcaggctctattacttgaagggccagtgctgcaactgcgcacttgtgtaactcttaacccagtcacatttcttccagacaatgaagaaaagatagaacataactgccaacaagtaattgctcaaacctatgccgctcgaggggactttttagaggttcccttgactgatccccacctcaacttgtatactgatggaagttcctttgtagaaaaaggacttcaaaaagtggggtatgcagtggtcagtgataatggaatacttgaaagtaatcccctcactccaggaactagtgctcagctggcagaactaatagccctcactcgggtactagaatcaggagaaggaaaaagggtaaatatatatacagactctaagtgtgcttacctagtcctccatgcccatgcagcaatatggagagaaagggaattcctaacttccgagggaacacctatcaaacatcaggaagccattaggaaattattattggctgtacagaaacctaaagaggtggcagttttacactgccggggtcatcagaaaggaaaggaaagggaaatacaagggagccaccaagttgatattgaagtcaaaagagccacaaggctggaccctccattagaaatgcttataggaggacccctagtatggggtaatcccctccgggaagccaagccccagtactcagcaggagaaatagaatagggaacttcatgaggacatacttccctcccctccagatggctagccaccaataaaggaaaaatacttttgcctgcagctaaccaatagaaattacttaaaacccttcatcaaaccttccacttaggcattgatagcacccatgagatggccaaattattatttactggaccaggccttttcaaaactatcaagcagatagtcagggcctgtaaagtctgccaaagaaataatcccctgcactgcaggccatacatttcaatccctgtatctttaacctccttcttaaatttgtctcttccagaatcaaagctgtaaaattacaaatagttcttcaaatggagccacagatgcagtccatgactaagatccaccacagacccctggaccagcctgctagcccacgctccaatgttaatgacatcgaaggcaccccctcctgaggaaatctcaactgcacaacccctactacgccccaattcagcagaaagcagttagagtggtcatcagccaacctccccaacagcacttgggttttcctgttgagaggcgggactgagagacaggactagctggatttcctagactgactaacaatccctaagcctagctgggaaggtgactgcttccacctttaaacacgggacttgcaacttagctcacacctgaccaatcaggtaggaaagagagctcactaaaatgctaattaggctaaaacaggaggtaaagaaacagccaatcatctatcacctgagaacacaatgggagggacaatgatcaggatataaacccaggtattcgagctggcaacggctaccctctttgggtcccctccctttgtatgggagctctgtttttactctatttcactctattaaatcttgcaactgcactcttctggtccatgtttgttacggctggagctgagctttcgctcaccatccaccactgctgtttgctgccgtcgcagacctgccgctgacttccatccctccagatccggcagggtgtctgctgtgctcctgatccagtgaggcacccgttgctactcccgatcgggctaaaggcttgccattgttcctgcatggctaagtgcctgggttcatcctaatcgagctgaacagtagtcactgggttccacagttctcttccatgacccatggcttctaatagagctataacactcaccacatggcccaagattccattccttggaatccgtgaggccaagaaccccaggtcagagaacacgaggcttaccaccatcttggaagtggcccaccgccattttggaagtggcttgccaccatcttaggagctctgggagcaaggaacccctggtaacaaaacctgatgtttgttctctactaaggaataaaacaggcatacatgtgagataactataaagagtcaggacatgatagaggtctgcacactatatcagaagccctgtttccagctctgtggctgcagcatcgcacaactccagtgctctgcctgaggctggctgtgcatgcagagctgagccctaggttttggcaggacaagacatgttttattcagggagatgagaaggcctgtcaacatgtactgccccacctgctgcggccaactgtggcctccatcttccccagtaggcagggatggactgagggaggaaagacacctggggcacatctgaaagatgctttgggccggggacaaaaaagaagtgatagaaaccaggctgtgctttttattgctgtcaggacaattttcttaagacatgggggtttcttttttttttctttttttttttttgagacggagtctcacactgtcgcccaggctgcagtgcagtggcgtgatctcagctaactgcaagctccacctcctgggttcacgccattctcctggcttagcctcctgagtagctgggactacaggcgcccaccaccatgcccggctaattttttgtattttttagtagagatggggtttcactgtgttagccaggatggtctcgatctcctgacctcatgatccgccaacctcagcctcccaaagtgctgggattacaggcatgagccaccgcgcccggacaggacatgggggtttctaaacaaggctcttcagtatcagctcattgtgagtcacagatcagatctgcccagttctcttttgctgttgacattgttgtttcctctgcaggattcagcagtactgaaagggttattcagtcccaacatgggatctttacacaagaaggggagcttgtgaaatgcaagtactttgcaaatagctcaacttattttctttcttgttttgggcagcattccagtgaggaaatatttcacctgatttctcagagtttaggagcatccaggaacgcaaggaataaaaaatgttctgtgaacctgcaaatagctgccaacactgtcattctcaccatttcagttatgagaccaaaagactcaggaaacagtttctgtgcactcaagacatctacagtaagaggaacaataaaagttgtagttaaaaaaaacaaaaaacaaaatactcagagcttgtaccccagactcatctgccacagggactgggagagatccacgggccctaaactgaaaaaatgtgagcctgtggacagcattcatgaagtatggacaggaaacaggtaactgttgcaagaaaaaccctctcaaactgcattcattgagcagtgctttcaatccacagtccttaaattgactttctccttcaaattttagcaggtaacaaaacagtactttattttaatctaattatttttcttttttctttaactttttatttgatatatttcaaaatataaaataatactgcttattgtaatagatgaagtaataaaaagttttataaagaaaaagttaattctcactcatctgctccctactgaagtaaataatattaataacctgataagtgtcctttcccactattctttctgcttatataaatataggcaaaaatccctcctagtggaacaaatctgcttggggttttttttgttttgttttggtttggttttctgagccggagtctcgctctgttgcccaggctggagcgcagtggcatgatctcggctcactgcaacctctgcctcctgggttcccaccattctcctgcctcagcctcccaagtagctgggactacaggtgcccgtcaccacgctcagctaattttttgtagttttaatagagacggggtttcaccttgttagccaggatggtcttgatctcctgacctcgtgatccgcccgccttggcctcccaaagtgctgggattacaggcgtgagccaccactcccggccacaaatctgttaataaatgtgtgaccaattggaatttttcctctgaatcgccttttacatctttgtccatttttcttttaggttatatatttctcacttaaaaatgcatgctagagatgtcaaaaattttttttatttctccagtctattgtttgtcttctgattttgtttatagcacgtagcatggtatcctttgcctctaaatatactctaaactgtatatagttaaatatgcctgtcttctttatatcttctgcatttctaccatacttaaaaatagtacaggtttatataaatattcccagattcttagacaacagttttatcattttgctttttacaataaaatctttcaaccatctggaaactgtttttatatatgaaatctattttccactattgaaatgtctttgtcatattttatgtttcttaaacataatcaaattatatacatccatattaagaactttaccagtatccaaacattacagaataatgtaagaatcacagtggaactgggtgctggtgaaaataatcactgaattctccagtgccagtttgaaaggagaaattattagccattccactggggtgagaaaggccaatgagtttgactgatgttaaccaaagagagattaaaggatggactaaaagtataaaggggtgacatcttggggaaatgcaagtcttgtgcagagagaggaagatgtttaacttatcctactcaactcctttcctatatgaccggaggtgcctagtccagcttccacccactccactaagttgaggaatagctatcatcacatgtctggaagataatcagcttctgaactggcagagcgtctctggttcttgtggcaaagacataaaatgtgggagaaagtagagaaaaagaaagtgtggtagcctgcattcccaccttttattgaggcaatttttcatgtactagtggttttaatgaatctgtataggtctgaaccaacttgaacctgaacctaccctgcctccaaacagctgtcacttaggggaaggctctagcacaggaggctgtggattgacccatgtgtgaactggaggaggaggaggaggttgagcttgagaacgatcaccactccaggaaatcacgcagatgaagggccctgtagccccctgaagaaaacactagcacaccgttgtgagaaagcacacatttggatttctgccaccaagagggaatccatggccaggaagagataagaaccaacaggaaggagaaggaacctctccatcagaaccctgagaaattcacataaggaaacagcatctgagcaaccaagaagacaaggcccctcagcccaggagaggctgaaaagagagtcctttatttctcccaccactctgcccaacagctgagggttgacatggggtgaagtctgaaagaatagcacatctacctgtcagtggagctcccagagtcttcctgctgggtgtgggtggagggtagagctttgactctaaaatactaattaagttcaaaatgaatacacacatagttggaacaaaactgctttagtaactaaaagagaaaggataacctgtttcccagtggaaaagagatgattgataagtgaaaaaaaaatgaaaacaatttcacactcacatttatctcatgacttgaaatgctctagtcagcacagtaatatctggatctctttgggtattttctattaaatgttccgcttattggcttaatccttcacttatatcatattgttttgtttagagtagtttagagtaagtttttatgtcataaaaaaactgatcttaatattccttttcaagaatgcagttgaaagttcctagatatttgttctctcttatgcatttcatcttgttcaaacaaatggcattctgactgtaactactttggaaagtttaacattttaggacattatatttttccacaaaagaaaaatccatctatttaggtcttattttaaaagtaaattttgcatgtttgtttgtttcttacataccttccactttctttttttttgagacaggatcttgctctgcagcctaggctggagtgcagtggtacaatcatggctcactgcagcacagacctcccaggctcaaatgatcctcccacttcagcctctaaagtagctgggattataggcatccaccatgcctgactaattttgttttttagagatggcgtctcactgtgttgcccaggctggtcttgaactcctggcctcaagcaattctcctgccttgaccttccaaagtgcagggattacaggtgtgagccactgcacctggccagatttctgcttttcttattaaatcaattgctaaatattgtatcatctgtgttgcattattactgaaatttttcttcatttagagaaatttattccatataaggaaaaattactaatttttaatatttgcttaatagccaacaatttttgttacttgttgatttttagcagtactatgaccaaagtggcacatgtacatgtttattttttaaattcctgaatagtacagaaaagtctgtattacaaatctggtttcttatttctctccaactttcaatccttgtccataaatatttacacttttaagtctggatcttctagcagtgagctccatatttctaaataatatgttttaactacttcttgcaacatacattttattcttttattttatttacttatttttttagatggagtctcacactgtcaccctggctggagtgcaatggcatgatctgggctcactgcaatctctgcctccggggttcaagcgattctcctgtctcagcctcccgagtagctgggattataggcatgtgccaccacatccagctaatttttgtacttttagtagagacggggtttctcctcgatggccaggtttgtctcgaactcctagccccaactgatccacccgccttggctgcccagagtgttgggattacaggcatgagccaacgtgcctggctgcaacatgaattataggtgttacctgttgactttcgttttgttttttaaatagacttaattttttaaagcaattttaggttcacggaaaaattaagcagaaagtagagagtttcccatatacttccaggcctcacatatccacaggctcccatgctatggacatcttccaccagagtgataacatttgttccactgatgaagctacattgacgtattattattacccacagtccatagattacattagggttctctagtggtgttgtacgttacatgggtctggacaaatatataatgacgtgtagccgccattacagtctcatacaggttgtttcactgccccaaaatcctctgtgctctgcccgttcactcctccctccccccagctcctgacaaccactgatcttgttactgtttccatggtgttgactattccaaaatgtcatatacttagagtcataacagtatatagcctttttagattggcgtctttcacttagcaataggcatttcagatttttccatgtgtttcatggcttgatacctcatgtcttttgagtgctaaataatattctgttgtctggatgtaccacagtttatttacctattgaaggacatcttggccacttccaagtttgggcaattatgaaggaagctgctataaattcatgcacattttgaactcatttgcttaaataagaaagagcataatttctggatcatatgcaaagaatatgtttagctttgtgagaaactgccagttttcttccaaaatggctgtaccattttgcattcccaccagcaaggaaggagaattcctgttgctccacaccctcactggcatttggtatcgtccgtgttttggatttttgccattctatctggtgtggagaggtcgctcattgttgtaatttgcaattccctagtgacatttgcatggagggtatcttttcatgtgcttatttgtcatttatgtacatttttaatacgtttcactttgggggtcatttagccttcacctggcaaaacaaacaaatgaaaatttacacataattctgtgaattaatttttaaaaacttcataaacctcacctttatccacttttattcttacttatatttacctagtcagacttttcagaactttttccaagttgtcagaacatatttaaaataataaaattaaaataggaggaatttttgcctgtcacctttgctcttctctcttttccctcatccactcccacaccttttcttctttagtttccttccccaaccattccaaacactcattatgcccaagcctctttggacacttcgatcaaaattttctcctctatatcatccggaggaaatgcaccgtttgctcagggacacttagctcacctgcttcccacgttttctctcggtctccacttgtgtctggactgagtgttgctgaccaccacagcatcaaagagcctgtgagaccactggatgcagtctgggggtcagtgacctcagaggaaataccttcagtgtcccacgggctctgcaggtcagtgcactcagagtgagcttcctcacactttgctggggaaagtgtccagtagcttcaataatctcatgaccaaaagactgaagagaggggagaagacatccgagttcacattttcaggcaatagtagctgacatttcctgaatgatccttgtgtgtcaggcaccttaggtccgttcatgacttaccacatgtttctgtatgacagcaccatggggaagcttctgtaattaattcctattggataggttgctgctgatggaagtggggtctccaaatcctctatcccagagtctgtgctgttctgcagactgaatatgctttctccccaccccttcctcaggctttggcaaaggagacctctgaaaaatggcacttagtatattattgacttttgttttttaattggcttttggactaatgaggtcagtataatgtgtgaaaccaaactagaaggcagtgctggtaagtttgttgagtctctgacaaatatttggattctgagcaattcaaacatccaggcaactttaaaaggtcttcttcctctgagactcatagtgacttatacaaataaaaataaaagattagtaataatagtagttcatcaaacactgcatttacttatattttctcaaatactattttcttttttttgaggcagagtcactctgttgcccaggctggattgcagtgatgcaatcttgactcactgcaacctctgcctcttgggttcaagcgattctcctgcctcaatctcctgagtagctgggattataggcatctgccaccaggcctggctaatttttgtatttttagtagagacagggtttcaccctgttgtccaggctggtcttgaactcctgtgatcacccacctcggcctcccaaagtgctcaagtgatcacccacctcggcctcccaaagtgctgggatttcaggtgtgagccaccatgcccagcttcgaatactattttctaccataccatttaaatgtcattcaaatttaatattttccacaaattttgaaagaaggcaatcaggcaaatttcatctcagtcaaataatccctaaagttacacatgctgtggctgtacctttctcaactttgtttcccttcatccagttaagacttggttgtgcagagttaggggctccgcaggtgatgacatgatcaaaggccctgacccttgtcacaagagtactcactaagaataaaagtgtttgacatcctctcagcaactctgatgtgtaatcccaccagcaattagtgtttttctttctccgcgttgattacagatagtttgcttttccctgtatgactgcaaaggtgtgtatatttgaatgtatgtctgtatgttgtttgggttgcagggaaggaaggagtagaaaaaggaataagaggtggctgtgattggctggtcgctctgaatgcaaataactctatgcttttcacctttagtgaatatataaatgtctcaggataggagcgataataaataatgccaaagatcttccttagtggtcctgtggcttcattgaaggcatacattgaaatgtttctagccaggtgcagtggcttacacctgtaatcccagcactttgggaggccgaggcaggtggatcacaaggtcaggagttcaagaccagcctggccaagatggtgaaaccccaactctactaaaaatacaaaaaattagccgggcaaggtggcacgtgcctgtaatcccagatactccagaggctgagacagagaattgcttaaacctggagaggcggaggttgcagtgagccgagatcgtgccactgcactccagcctgggtgacagagcgagactccgtctcaaaaaaaaaaaaagaaagaaagaaagaaagaaatgtttctgaacaggggaaaagccaaatgcaatgggcattcccgaaagactgaagaaagaatacgtgcaagttgattcttctggggtttccaggaaagttgggaaaagaaaatgaatcatttaaaaagtggagagctgatgcctggccctctgtacttgtttctctcagggaagaaaggcagcagaaagtagagcagtgtcccagtccacacgtgtccagggaagagaggcttctatttttaactgcagttacacaagactgttggcttttatgtttcagacgcagtgctgtgaaagaccatgtccttgtagttttcattatttcagaggtaaaatggaaagcaggagtaagagccccaatcattaagaacacggcttagctctctgcagatcacagactcagccaccaactcctgccctgtaaccatggagatgcccccacttcagtctgtacacaaccccacaagaggaaccacttactcgcttccttttctaatcagcatgaaataatatttttcataattattatctgaggcttttctatttcctcctctctatctactttgacaacataaaaatatattagggcctggtcgtggtggctcacacctgcaatcccatcactttaggaggctgaggtgggaggatcacttgagcccaggaggtcgaggctgcagtgagtcatgatcatgccaatgcactcagcctgggcaacagagtgagaccctgtctcaaaaatatatatatatacacatatgtattaggcattatgctgtacacaaagagcttattatctaatacacatgataatatctgtcactagatgtaagctttatagagataccaatttttttatccaataaccactaaccaaacaatgatcaaataaataaatggcaggttatatgtataccgatgtgtaaaggcaaatttatggccaatggttaaaatttactgaaaacaaatttcagctcgctataaaaaagaactagcaatcagagttttcccaaaaagaaacagacagctttaaggcataaaatattcctttctacaggaaatattcaaagaaaagtagaatgcccatttccagtgatgttgcagaattacaaaatgatatgattttgtgcaaaactaaaacatgtaagttttgtatgggggaaaatagcatcgaagaacagaacaaccaaacagcttgtaaaatgcatcgtgaataaaaaaagctacttccagcttaatggaaattggattttggatttgtatttgaagcatgtgtaggatttaaaatgagagagatggtaagagaatacatgccaggcaggataatcttatcaagggcaatgatcaagaaataacagagagaaaggtttaggaaattagaagtttccaaatatgactgaaagaaccaatttttattggaaaatgctgtgagataagagggaatcttggcttgagacaattgttagtgtaagaggactgcacacagcccagaactgggtttctttccagacaaagagaaaatggtatgagattatccatccttaccataaacaacattaaggaatatcttgaaattgtttttcagaaagagctaatattaacctaaatttaaactgttaaataacatcaaagatttactttacaagcacatttctaaatgtactgaaaaactatatttccataataattgattcaatggacagataaatttccttttccctgagtagttctatcatcaactaatagcccttattgcaggaaacgaaaaatctaaacacttttccgaaagtgtcgcgattccccgatcactttccagcgtgaattttcttaggggtgaggatgggaacactaatagtttctctgcactcaggaacctcataaaggacaaactttcaaatcaaataatacagaccaaataaataaaacagagctacatcttgctttgctttacacttcgttctcttccttgtctgtctgcaaaaacctttgcatgattttcattgaaaataactcctgaattgatgcgagattttacttaccctgggacctacccaggcctggtttagatatgttcccatagtcttccctgctcttccgggtactgagttaccataaggataaaccaggcagacagttcttagacattagggctaatttctaatttacccccctgtgtctttcttttatcatcacaaacatgtttggtgtctaatttggtttactcttaggaaaggatggtttggagtacataaaacagaatggttcctcaggcagcaatatgctacagttttagagatcttgtagctctatttttctattaattgatgcaggttttgagaatcaacaagcacattaaaaatagacatcaacactatagtaaaattaaaacagttattctgtcttttgttgttgtttccacattattcagaaagagaaaagtactctttaaaattagaaatggagaacaacaaggaagagaaatctattttgttgaaaaacagcttttggtaatattattcagtgaaagatgaagtgacagacgtggaaacttctagtcaaagtttgcagcttttatttgcattgaatatctatccaagatgaatcatcctagaaaagcagccagtggacttggaataatctcgctcaccatggtttctgccaaggaaggattttcttggcgcagaatgttgggtatttatttggggtcttgaatgggtgaaagagacaaagaacaatttacgagaaagaaaggagaagaaggaatggatccatggacagaaaagatttgtcctcaagggtacatccaagatttgctttaatctgtcatataatggaaatttgaaacagttattagcacaggttcacagcttctcaaaactaaaaaccattgtggaaaagaggctaagcacaaagatgtaagcactaaatgagtataactgctttgcagacagtttcatgtcagtggacatgtgccatttttcttctttttttttttttttctgcccagtgcagctgccacatattattcaatgcacaactttacagggcatcattcacatcttagtaagacatggagaaagacaatgctgagataaagaaaagcagatttccgagagcatcatcagagcctacaaattcagctctgcctggagctgcaaaagtcaaaatattctttttggggatcaagccagcatgaattgagattctgtcatttacagccaatggattcataattctcatagccaaaagggagagggatacttttggttctctgttattttatgagctgaatttatggtccacagaagcattttctactcaaaataactagagttatgtaaagacaaataatcattggtctactctcattatgggaaataagagccataataaccctatgtgtgttttatgaatttcaaatgggaaaaattttgaaaactactaaaaattcataactctacattataaacataagaactcttactttttctatttttactttttaatttccacttttgttactatttttacttattttccttgtttacatttttgcacatgaggaaatcatattgtaagaataattttatgaaattttattctcatttttagaattaaaaatgccttggatttatagtttgaattggctactatttcacaccgtagatatacaatactttataattttcctgattggggatatttttattatttatttccaatttttattattttaaatagcattgtggtaaacatctttaaatatacattttattttatttatatatatatttttattatactttaagttctagggtacatgtgcacacgtgcaggtttgttacatatgtgtacatgtgccatgttgttgtgatgcacccattaactcatcatttacattaggtatatctcctaatgctatccctcccccctccccccaccccacaacaggccgtggtgtgtgaacttccccttcctgtgtccaagtgttctcattgttcaattcccacctatgagtgagaacatgcggtctttgggttttttgtccttgtgatagtttgctgagaatgatggtttccagcttcatccatgctacaaaggacatgaactcatcattttttatggctgcatagtattccatggtgtatatgtgccacattttcttaatccagtctatcattgacggacatttgggttggttccaagtctttgctattgtgaatagtgccacaataaacatacgtgtgcatgtgtctttatagcagcatgatttataatcctttgggtacctacccagtaataggatggctgggtcaaatggtgttgctagttctagatccctgaggagttgccacactgtcttccacaatggttgaactagtttacagtcccaccaacagtgtaaaagtgttcctatttctccacatcctctccagcatctattgtttcctgactttttaatgatcgccattctaactggtgtgagatggcatctcattgtggttttcatttgcatttctctgatggccagtgatgattagcatttaattttcatgtgtctgttggctgcatgaatgtcttcttttgagaagtgtctgttcatatccttcgcccactttttgatggggttctttgtttttttcttgtaaatttgtttgagttctttgtagattctggatattagccctttgtcagatgagtagattgcaaaaattttctccaattctgtaggttgcctgttcactctgatggtagtttcttttgctgtgcagaagctcttgagtttaattagatcccatttgtcaattttggcttttgttgtcattgcttttggtgttttagacatgaagtccttgctcatgcctatgtcctgaatagtattgcctaggttttcttctagggtttttatgattttaggtctaacatttaagtctttaatccatcttgaattaatttttgtataaggtgtaaggaagggatccagtttcagctttctacatatggctagccagttttcccagcaccatttattaaatagggaatcatttccccattgcttgtttttgtcaggtttgtcaaagatcagatggttgtagatgtgtggtattatttctgagggctctgttctgttcaattggtctatatctctgttttggtaccagtaccatgctgttttggttactgtagccttgtagtatagtttgaatacaggtagaatgatgcctccagctttgttcttttggtttaggattgacttggcaatgtgggctcttttttggttccatatgaactttaaagtagagttttccaattctgtgaagaaagtcattggtagcttgatggagatggcattaaatctataaattaccttgggcagtatggccattttcatgatattgattattcctatccatgagcatggaatgttcttccatttgtttgtatcctcttttatttccttgagcagtggtttgtagttctccttgcagaggtccttcacatcccttataagttggattcctaggtattttattctctttgaagcaattgtgaatgggagttcactcatgatttggttctctgtttgtctgttattggtgtataggaatgcttgtgatttttgcacattgattttgtatcctgagactttgctgaagttgcttatgagcttaaggagattttgggctgagacaatggggttttctagatatacaatcatgtcatctgcaaacagggacaatttgactttcccttttcctaattgaataccctttatttctttctcctgcctgattgtcctggccagaacttccaacactatgttgaataggaatggtgagagagggcatccctgtcttgtgccagttttcaaagggaatgcttccagtttttgcccattcagtatgatattggctgtgggtttgtcatagatagctcttattattttgagatatgtcccattgatacctaatttattgagagtttttagcatgaagggttgttgaattttgtcaaaggccttttcggcatctattgaggtagtcattggtttttgtctttggttctgtttatatgttggattatgtttaatgatttgcgtatattgaaccagccttgcatcccagggatgaagcccacttgatcatggtgcataagctttcggatgtgctgctggattcggtttgccagtattttattgaggatttttgcattgatgttcatcagggatattggactaagattctcttttttttgttgtgtctctgccaggctttggtatcaggatgatgctggcctcataaaatgagttagtgaggattccctctttttctatttattggaatagcttcagaaggaatggtacaagttcctccttgtacctctggtagaattcggctgtgaatcatctcgtcctggacttttttcggttggtaagctattaattattgcctcaatttcggagcctgttattggtctattcagggattcaacttcttcctggtttagtcttgggagggtgtatgtgtcgaggaatttaaccatttcttctagattttctagtttatttgcgtagaggtgtttataatattctctgatggtagtttgtatttctgtgggatcggtggtgagatcccctttatcattttttattgcgtctatttgattcttctctcttttcttctttattagtcttgctagtggtctatccattttgttgatcttttcaaaaaaccagctcctggattcgttcattttttgaagggttttttgtgtctctatctccttcagttctgctctgatcttagttacttcttgccttctgctagcttttgaatgtgttttcccttgcttctctagttcttttaattgtgatgtcagggtgtcaattttaaatctttcctgctttctcttgtgggcatttagtgctataaatttccctctacacactgctttaaatgtgtcccagagattctggtatgttgtgtctttgttctcgttggtttcaaagaacatctttatttctgccttcatttcattatgtacccagtagtcattcaggagcaggttgttcagtttccatgtagctgagcagtttggaatgagtttcttaatcctgagttctagtttgattgctctgtggcctaagagaaagtttgttataatttctgttcttttacatttgctgaggagtgctttacttccaactatgtggtcaattttggaataagtgcaatgtgttgctgagaagaatgtatattctgttgatttggggtggagagttctgtagatatcaattaggtctgcttggtgcagagctgaattcagttcctggatatcattgttaactttctgtctcattgatctgtctattgttgacagtggggtgttaaagtctcccattattattgtgtgggagtctaagtctctttgtaggtctctaaggacttgctttatgaatctgggtgctcctgtattgggtgcatatatatttaggataggagaattgatccctttaccattatgtaatggccatctttgtctcttttgatctttgttggtttaaagtctgttttatcggagactaggattgcaacccctgcctttttttgttttccatttacttggtagatcttcctccatccctttattttgagcctatgtgtgtctctgcacgtgacatgggtttcctgaatacagcatactgatgggtcttgtctctttgtccaatttggcagtctatgtcttttaattggagcatttagcccatttacatttaaggttaatattgttatgtgtgaatttgatcctgtcattatgatgttagctggttattttgctcgttagttgatgcagtttcttcctagcatcaatggtctttacaatttggcatgtttttgccacggctggtgctggttgttcctttccctgtttagtgcttccttcaggagctcttttagggcaggcctggtggtgacaaaatctttcagcatttgcttgtctgtaaaggattttatttctccttcacttatgaagcttagtttggctgaatatgaaattctgggttgaaaattcttttctttaagaatgttgaatattggcccccactctcttctggcttgtagagtttctgccgagagatccactgttagtctgatgggcttccctctgtgggtaacccgacctttttctctggctgcccttaacattttttccttcatttcaactttggtgaatctgacagttatgtgtcttgtccactccagaccctgtttgcctgggtatcagcagcagaggctgcagaacagtgaatattgctgaacagcaaatgttgctgcctgatcattcctctggaagtttcatctcagagggatacctggccgtgtgaggtgtcagtctgcccctactggggtttgcctcccagttaggctacttggggtcagggacccacttgaggaggcagtctgtccattctcagatctcaaactctgtgctgggagaaccactattctcttcaaagctgtcagacagggacatttaagtctgcagaggtttctgctgccttttgttcagctaggccctgcctcccaaggtggagtctacagaggcaggcaggcctccttgaccttcggtgggctccacccagttcgagcttcccggctactttgtttacctactcaagcctcagcaatggtgggtgcccttcccccagcctcgctgccgccttgcagttccatctcagactgctgtgctggcaatgagcgaggctccgtgggtgtgggtccctccaagccaggcacaggatataacctcctggtatgccctttgctaagaccattggaaaagtgcagtattagggtggaagtgtcccgattttccaggtgccatctgacacagctttgcttggctaggaaagggaatttgctgacctcttgcacttcccggatgaggcgatgcctcgccctgcttcacctcatgctcagtgcgctgcacctactgtcctgcacccactgtccaacaagccccagtgagatgaacccagtacctcagctggaaatgcagaaatcacccatcttccgcgtcgctcatgctgggatctgtagactggagctgttcctatttggccatcttggatccacccctaaatatacattttaatttaactttttatcgtttcattaagacagcatcctcgaactggaattagtggttcaatgggcaaaacagctttatagcctgttggttccttgtctgtcttaatagcataacaccttttaaaagctttctaaattccttatctctactccctaacccctttcttactcaaaacccagtccaggcagatttttatccctatccttgtatcagaatcactttgttaaggtcacaatgggtttcatagcctcaaatccaatgatccattaccatgttttatcttactgaatttctcagaataatttgacaatttggttattctctccttgaaacattatctttgcttgagtttggggattccacactttcctggtttgctttcaacctcacaagccactccttttctagctcaccttcctcttgctgacctctagatactgtgttgtctcaggactcagtcctcaaacatatatgccgtctacatgcactctctaagtgatttcatccaggaatatggctttaattaccatccatacattgatgactcccaggtttatacctccatccaacccctctctgttgaaagccaggctcatatatactataatctatataacatctttgccagatgtctgtctggcatctaaaatctaagatatccacaacataccttattccctcccttacgctcatccctcactcttccccatctcaagaaaacagtgatataattcacccactcgctatagccaaaaatactggaatcttctttaattcttctctttcccccataccccacattgtcaacaaactggccacataagatgtgttttctgtcagaaaaaaaagcctgacttcattttttaattcaaataagaatgttacatgatgggttccaatgacaacccagtcatttcataattctaattctaaagtaggtagatgaatatggtaaggaaccttgcattgaggctgtcgccagttgaaatatattcctgttttgcaatatttcttgcttagcttttaagggctctcccgcagattccagaagctaataaattgtctctttatttggcagcttgggaattttttttttagcaccctggaccaatgcaccattccggatggttgagatatatactttttctttaaggggtaggaggtaagggtgatgttggaaagagaaatgggaaagaagcagcagcttaacatttggaccctgaagcatgttctagagcaggctggttttaagaaagtcctcatttgcctcaaggtacgtgaccccagtttaatgactataggcctaaatgggacaggatcacaatcacatttgtcaccagcagactcatatctaggaggcatacaagttattcctgttagaacagtgacttactggaaagtcatttcccaccactgatttgagtcgctgttattatcgtacatgaatttccatatacaattaggccatattacagatttgctattccatttaactaacctgtctgcctacccttaattttcacttaagaattttctttctctttcttttcacttctgtgcaatagaaaatatactcttttcttctacattttcttctgtttttttttgttttggcataagaatgacaggaattttttaaatgtttaattgtagccaatcctttgctagtggtctttgtcctcttttaggttttctgatgtacagtcattttatctacttacatgcagatgatgttttatctcttcctttccaattcttatgcttcttattgtttctctgggctgactgcattagcaagtagcttcaacacaatcttagatagcagtagtggtaatgaacatctttttccttcacctactttaataggaaagcctctagcactttcccataagttggtgctggtttgggattacggtgtatgcaagttttatgtgatatgttaaagaattagttattagtttttatttttcaatgttttaacatgaatctgtgttgtattttgtcaaattccttttctccatcaataaagataatcatatgattttttttcttggctcttgtatcagttattaagctactaactcttacctacaattgcttagctcctatacctcgcttctagagtagtaactgctgatgtcaatcatacactggcccctagagctagttgactttttaggtgtgtttttcttctctctccaactggataattagcatattctattttgtacattttattaaatgtctccacagggttaagtgaatttgttgaggtagtgacactcaacatttattgtttacctgccacaacccctgtccatcattgctcagtaaaatcgttaatcatctatagctagacatatacctgctagtacctacctagaatgttgaaatcacatacctgagataagagagaagaaaaattccaaggagaactctcatgtaaatgctacttcctccaagcatctaaaacagctcctctattctttctaggaaaaaaaatcccttctttgaggacattcctggtaagtatcctcataaatagaaaaaaaattttacaaagagaactaaagttttgctagcatttctgtggtttcagacttaatgtgatgtggggatgctctgattgggaaaaagaaagatcataaggtttctagggaagtgtaccagtttacaaatagccagattctccagtgaccacctcatgtgtctattgtttttttctcaagcagaaatgtgaaaacaggagaaggtagagtccagtcttacccaaaccctgcatgtccaggagaaagctaactctagtctaagctacaaaaaacgaaaaaaaaaaaaattctccttgttttacataatttcatacacaaaaaagaatggaagagtaatatccacaattaacatcaaagatcctcttattcttcatagactcagtgtagaggctcagacacttatgtcatgaccacagaaagaaatgaaggaagaaaagaatgaggatagatttgctagggccagggctttacccaagaaatatagctgagaaaatgtgggagggtaataggtaggcacctatgctccacaggatgagacctggatgcaaagaacagatgagagctttcttccctatcctctcctcatcttgagtccctagtcattgctgcaagtacaggaaaccataaaacagagtttcagaaaactaatatgtaaaacatgagaaattaccagtgtgcacaggtgcccagagctaaatataaagcacttggatatttgcaaaagcactagcatgctcagagttagccagttactagactgctttctcacacctgaaaacatcctaaaagaaaggatactacattttcctcctttgtctttttaacgagaatttggaaaaggtctaactcttttaacttatttaaagctgctgagattgagacatataatacagctctggtagaaaaataatcaattaagggaaataatcagatcttctctcaacctattcctacccccctcagaatgtactacagtgccatagaggcaaaaagcctgcataattctttaaaggtgaggggagtgagggagtttcaggtgtaaaggattttcagacagtcataactggagaaactttccttttaacactgtttgctttctttcttttttgtttgctcctcacctctctgtatgttccgtctacctttcatttcaacataacgagttactttatattaagggggaaatgaaaaaacaatttttttgagttcagaccacctgggggcagtgcttcctttgacagaggcactgccagaaactagaacaaggggaagggaacagcaggaggagggcattcaatgatgtgtgtgatgtaacagtgaggttttgattatccgtaaaaacaatgaagattccccaaaggctacccaaccaacagaaccagaagactctagaacagtgaactaggcccagtgaacacggccaaatctaggtctccaaactgaatccacagaggctccaggaaaaggaaagaatggaaactccactgagcactctgctgctgctcctctgtgtgcagctgacctgtgagtcaggcgagtcatgaggaggggaggaatcaagtaggggcggccagggcattgaaatttagaaagatcccggggacaatcttgggtctagtctcaggaatgtaaaacaaataatgaaactgatgaacaaacacactatatatatgaaaatgtttcattcctcctaagcagggtcaaatggacaactgccagtggaacagaatgctccttccctgaaagtcaaggaaggtgacagcgtcacactgaactgcagttacagagacagcccttcagatttcttcagtggttcaggcaggatcctgaggaaggcctcatttccctgatacaaatgctatcaactgtgagagagaagatcagtggaagattcacagccaggcttaaaaaaggagaccagcacatttccctgcacatacaggattcccagctccatgactcaaccacattcttctgcgcagcaagcacacagtgcccacagtcacctgcacccggtacctaaagcttgctgaggggcctgggcacacctccttttataagggccctggggcactgactataactctgctgcatacaaagggaaatatgagggactgttttataacataatatcaaacatttcatttgaagaccatgtgaggaaggatagtgttttcaaataccatctaaagtactttgtttctcagtgtgaggcccttcctttgtgaaaactagcccaaaaactagaggctaaatatcaaaaaggagagagcactaaagaacaaagaaagaacagggtaaaattcttgtctttgagcttctttgtagacttttacaaagatatagaaaatacaaaatcttgaaagccatgaccatcaaattcagtagtgaaaggaaaaatattttgacatgccaaaaagattggcttagaagatcaagtaccaaaatctgagggaaaattgtacaaagcatttaaaggaaaagagaacacaacatggtagaaaagctgtcttctccttaaaagggataaaatgccaaccagctagctagaaaggaagtcaatgatgtgaggagaggtcataaacagtgagtccagcatcctgctcttttctagggtcagagctctgagcaggtagggtgggaggagggtgagtcacatttagcaatgactctgaactgaaggaacagtgaattttggcaaaaactgttttgatcattgtgtcttatatcaatactcacaagaaaacgcccattacagaggaagcattcaacaaccatgtggacaagacggtcggtccaaagcatgtcagccagccagagaatgtctgtgcttgtcaatttcttgaacaatagacccatgaatagattagctgaggtgacagattgagtttctttataagcccagaagcatgggttttctcccaccaagacagattcagctacttctgctgctgtcacaggacttttccttagttcaaagacagggttcttttcccatgggcacgaaaattcaggctcgcaaacaatttgaatggtgagtaagacacggttttattgggtgaagaggaagaaaagggggaaacagggactcttacaaggccagagtccctgctagagcacttcccaccccgcagttcgaatcccaggttccacacaggaagaggaggagcctggctcctccccactgcaaaggatgccaacttctgcggctccaccccagtgcacaggctgcttggaatttctctagggaccccctcccacctggctgtctcactaccaaatgtccaccctgtcagcagtaaatacaacactgagccttcgatgtggaatcatccttcaaaggaaccagccacacactagttggcaagttgattacattggaccacttccaacctggaggtattaggaattttttttcttcttaatacatattctgggtgtgaatctgtggtctcctccaaagtgccacacatagttgcatgaactgatggctcagagtgtctcattgatcattctgatcatcaaaggatttcacatcccttgcatcaacagacccactttatatcaagggcgtgtgacagtagtcatgtcatatagcatatagcttcatcatacagcattagccatgaaccactagcctgatagaactttggaatgaccacttaagggcccagctaaagcaccagcttagggacagcaccctgaggggctgaaaagctattctttgagatagtgttgtgtccctgttacataaaatacatggacctgggtagcaagggatggaagtaggactatcaccccatcaaccaccactttcagtaacccacttttgtgcttcctgttcttataactataggttctgctggactagggattctgtttccctttgagggggaaaagggaggatgctgcttctacgagggaaataggtttttaccaaacccaagataatatatactacctcataatttggggatcttcatgccagtcctggaggccaagaaaggagttactactgtcatggacaagttgatcctgattatcatgaagctaaaccccatagcggaactggggatatatgtctacaactcagggaattcactgtgatgacttttagcactttcatgtcagtgattatcgtaaataggcaactgtagcaactacagcctgacaagagcagactaaccaggggcttatacccctcggtgatgaaggtctaggttacctccctggaaaagaaatctagagcagtagaaaaaaatgctagccgaaggtggggagaatcaagaataagtagtatagaaggtagatggaggagataataaatatgagttgcagtcatgcaactaactataacaaacgtaacttgtcccagtaaccctcttgttgtcaaaacaacatcaacaacaaaaactagtgatctatatgaatttaacacacagcacaagtggatctgagcaaggcaaggagtgaactgtatagatactgttggttccctacctatatctcctaggcagtcacgccaacatgctggacaccactcgctgaaaatcccagcaaccctgaagatgactttgactttctggccatgaatgtggaggctgtggaggacaagccagaaatgcaaaagagttaatgccccaaaagcagttcttaatcagtgatagacagggagtttaggcatgattactccagtttcttcatgactcatttggcatagctccaaagagtatgctatgctgtctcttagagttattgtgacaggtagttagacaggcatgaatggggcacaagagagctctcccctccacccaccaggagtcatcaggcgattgttcggcagttatcacattacctctctaaaaatgataattggcagcaaattatcactggcaacttccccaacagataaagacacttaagattggtaatcagcttccaataaaatctcaggaattggtgagtgaacccagcatgtacattaagagacaaaacagcagagtatgaccttctgtgggcactccaccagaaaaaggaagaaagcctcagatgtgcatgagtacaacttcctaaacacactgctcatgcccacgtcccaagcaggaaggagggcactgcacatgcgggcagcccatcctaagggaagaatcatgggaaaggggcacaagatgctggaggtaggtcagtgtataaaatcttaggattaaggttaaaggctgcacttgtccttccagttgtccgcttgggtctcttccaagtgtactttcctttctctcctgctctaaagctttttaataaaattccactcctgttctgaaacttgccttggtctttcattctgccttatttccctcagtcaaattctttctgctaaagagacaagacttgaggttgctgcagacccatatggattcaccaccagtaactcagagccttctacccctaacattatccagctgcagaaagctgcaattgcccatcgtggtaactgccttgatggcacattctgtattggcttccttccttccctgatttacctcttacccatgtcttgcaaacaaaaaagagttaaactctgtaaaatagttaaagaggttgattctgagccaaatatgagtgaccatggcccatgacacagccctcaggaggttccgagaacatgtgcccaaggtggtcgcagtgcagcttggcttatacattttagggaggcatgggacttcaatcaaatacatttaaaaaatacattggtttgatccaggaaggtgggacaactcaaagcaaggggcaagggggtcagtgggagtgaggagcttccagcttataagtagatttaatatttttctggttgacaattggttgagtttatctaaagacctggaattaataggaaatgtctgtattgcgataagaggttataaagaccagagtttggtcaggcagatgaatcttccaagtagcaggtttcagagagaatggattgtaaatgcttcttatcagacttcaggtctgtgttgatgttaatgccagagaggtatgatgaagcatgtctgacccccacttcccattctggcctgaaccaatctctcaagttgaattttaagagagccctggccaagaaggaagtccactcagatggttgcggggggctggggggccttagaattttatttttgatctacagtttcctagaatcacctataataaactatttacacacaaattattgtgtcgaagctgacttttagggatccaaaaccaagatacaggaattcaaatcatgagacaagggtgaagattatccagaagaaatgttggtgccccttctcttattgctaccaagctgagctttgcagcacaagggattttagcagtctcattcaggatgggccccagtgcttacaaactccttaagcatctctctgagaggggacactcagccacctacctctgtgacagagaactcatgctcctcacacagcacccagtacataacagggcccccattcataatgcccagtttggggaccccaactcaggaattacataaggatccctgatgctccctctggaaatgcaaaattctaaagaatcagagtaaggtatttaaaaagagtttttttcacaatattttttcaaaatggaatgaaaatgataagagcaattcttgatataaatataaattaagctgaggcaatttagtgctgatgagaacttctgcaatagttatttcagagcttcttgatatagcataaacaaggtggttttgtttatttgtttgtttgcgtttgttttttgagatggagtttcactcttgtcgcccaggctggagtgtggtggcacaaactcagctcactgcaacctttgcctctcaggttcaagcgattctctgacctcagcctcctaagtagctgggattacaggcatgtactaccatgcccagctaatttttgtatttttaatagagatggagtttaaccatgttgcccgggatggtctcgaactcctgacctcaagtgatctgcccacctcggcctcccaaagtgctgggattacaggtgtgagccaccatgcctggccaacaagattatttttttaatccatgtaaaatgtgaacacaattacacactacatattctgcttttacttatctctgaatttagtcgatgctcttttcagccacaagcatatatcttttttctcattctttattttgagaaattataaaaatgtaaaaaaattgaatataaataggcatattcttatcactcaaaattaagtgtccttatttcataagatttgctttgtaattttttttaataagaagaaaaataaaatcacagtttgccatttgttgtgaatggagtcagaggcttctgctcaccattctggatcacgctctcctctccaagattaggtcgtattaaaaacaaatttgccagctccattttctctttatttttcttctaggctaactaaaagcactccagaaacattttttattttcatttgaaattataaccagaggcctattttctgagagaccaaaaagtattcagaaatgtttccctccttgaaacctagtcacccacccacctatcatagcatttcctgccctgaaggagaattctcaccaagcacagaggagaacccatcagagcaggagacttttcactctgcaggggagcgctgtcagcatgacacgagttagcttgctgtgggcagtcgtggtctccacctgtcttggtaaggaagatgtggttctttctttataaaggcatctaatggggctgtgaagcaggagggattaacagaacagcaactgcattgcctcttagagcccagctacctggaggcagaaatatgctgcctgaggctagaatcacaaagaaaggtgtgtgggaatggggaatgggaatcagcttgtgagtctgtttctcactcacacgtgatatcccagtgaagtcctttctctcctattttccacagaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctttcatgaagcacacaatgagatgagcagcagggagaggcttacagaaacctcagacctcagcatctgtgcaaaggtcacagggtgagagggaagtggtagggtaataggtatagaaaatcattgacttctcttggaaatgaaagcttctcctatttcttctcctgtaagaaactcagagagatggctgtctgcaagcttcaatccttaaagttacataaagataatgacgtgtgcagtgcattccagttttacaaggtgccttcactaaggtacttattacaggtcagatttcctaagcattttctctgtccagaaaatttttataatttgcctgggcattcttacctccaggaattttaaaccttttccatttgttaattgttgcttgtccttttatttgtccatctggtccaaaactgcatctcctccgaataaggtacccattttagaacacaacaggtgtgacaacggtggcataaccacgaaggggacttgctgggcccaccagactcaagagatgacctaggtccactgcagtagaacctagaagaatgatgaaaaggctttaaaatgctccgctgaagggccagctcgtgggcaacacctcagtggttggaatgctatgcttcagaaaatgataatattcgttaaaccactggctgattcatggtgtcgtggcaaaagtttagaaaccaagaaatagacatagaatagagtcttctcctatcactccctataagtcattttcagaattcgtgtttccctttcccacaaccctaggttctgctagattagaggtcctagttcccaaagaaggatgctcccttcggggattcagtaacctgcagctatggctgccacttttaggtcactctgaactctctgtgccaatagcccagcaggcaaagagaggagctattagaccagaaggggtcattgaccctgactgtcatggagcaccaggttgttgtgacacaaggagggtgaggaggaatgtggctataatgtaagtatttcacattggtgtctcctgatgtttccgtgcccaatacaaacagcaagcggcagttcttgtagcagcaaggcctgaaaagggcaacgtgaccaagaactgagactcttcagcaatgaagttttcaagaacagaagctcatgtcatgcaaccttcctgtattaagggcgttgaagagattgcagtcagaggcaaccttgaagacacagtgacacagtggaaataatatagggcaagcatgcatctgagtagtgcaaagaaaggactgtaactgatatatgcgccctgttgccccatccgaatgtctgtctgattttagctggagttatagtagacaatcacactcacgtcatgctggtaacatccagcgttaagcacactctgtgttttgttatgttatgttttgttttgttttgttgctttctatcccaaagtcttctctaatgtctcaggagatcccttagtttaagggcaagcacagcctgaaattatagggaaactaccacccctgttggcaaacaccaaccaatggggaaaaagagccagggaataaacgcactagctttgcgtcccttaaatagacaattctgagcggcaacctgtgtgcttcttgggagatcctaccagaaccgagtcccacttgagtcagttattgctcgacccactttcttcttttataacttatttttatagatcaagggagtacaagtgccacttttgatacatggatatattgtgtagtggtgaagtatgggttttcagtgtaaccatcacctgaatagtgtacattgtactcattaggtacttttcattcctcattctcctcccacactcccaccttttcaagtctcaatgtctgttatctttgtccatgtctatgcattatttagctcccatttataagtaagaaatgtagtatttgaatttctgtttctgagttacttcacttaagataatggcctccagttccatccatgttgctataaaagacatgagtttattctttttatggctgagtagtattccatggtgtgtgtgtgtgacattttctttatttaatcatccatccattgatggacacttaggttgattccatatcttttctattgtgaatagtgctgtgataaacataacagtgaagttatatttttgatataataatttctttttgtgggggtagatacccagtagtgagatgctgggttgaagagtagttctatttttagttctttgagaaatccctatactgttttccacacaggttgtactgatttacattcccaccaacagtgtatatgtgttaccaaacatctgttgttttctgacttcttattaatagccattctaactgatgtgagatggtatctcattgtgcttttaatttgcatttatctgatgattagtcgtgttgagcattttctcatgtttgctgaccatttgtacgtcttctttgagaaatgtctgttcatgtcctttgcacacttttcaatgggcttatttgtttcttgcttgttgagttgtgtgagttccttgtagattctggatattagtcctttgttggatgcatggtttgcaaatgttttctctcattctgtaggttgtctctttactctcttgattatatattgtgtggtacagaagctatttagtttaattaagtcccattagtctattttttgtttcgttgcatttgttttaagatctcagtcataaattctttgcctaagccaagatccagaagagtttttcccaggttttcttacagaatttttatagtttcaggttttatatttaagtctttaatccatcttgactttatagtaagagaaatggatccagtttcattcttctgtgtatggctaactaattttcccagcactatttattgaatagggtgtcctttccccagtgtatgtctttgtctactttgtcaaagatcagttagttgtaggtatgtggctttatttctgggttccatattctgttccattgatctgtgtgtctatttttcatacaagtaccatgctatattgatactatagccttgtagtatcatttgaagtcaggtgatatgatgcatcaagatttttctctttgcttaggattgctttggcattcaggctgtttttttgtttcatattgattttagcattttttcctaattctgtgaaaagtaatattggtattttgataggcattgcattgaatctacatattgctttgggcaatatggtcattttaataatattgctttttccagtttataagcatgagaggttttttcatttatttgggttatccacaatttctttcatcagtgttttgtagttttcctagtagagatcgtttacctttttgtttaagtgtatttctaggtattattttgtggctattataaatgggattatttattttgtggctattataaatttagtttgtagcttggttgttactgatgtatagaaatattactgatttcatacattgattttgtatcttgaaactttactgaattcacttatcaaatctgggagtcttttggaggagccttgagggttttccaggtataagacatatcatcagcaaacagatagttggactttttcttttccagtttggatgccttttatttctttctcttaccaattgctctggctaggacttctagcactattttgaataaaagtggtgagagtgggtatcctgctttacccattttctcactcctgcttcctgagatcacttcctaaataaactacctgcacccaaggtagtttcaggctctgtcttggggggaaatcaaactaatacagggaatctttggaaatccaaagattctttgaaaatttaacaaagaaagaacagaggagagttcaaggtgaaccttactgggctaagctaataaaggtaagtgtgtacttgagtgagaaattgtaaaaaaaagatgatgaggcagatcgcatttactaaactccaatctctgcagatatgtgattacgtcttttcagtgttcaaaaactttactttccaagtttaagctctttcaactgtctctcatttccccttcccaaatcttctgaccctttactatttaaacttcattcctagttattcccaaaatacgtctctcttctagtcagtttattccccttactggctcataaggacttaaagctcattgctggctctagcatttctctactggttgctccacccacccaaatttcccttttgtgtatatttcagactgcttaaaccatattaatcttataatgaccaccagaaatctctcttccctctaagatttcttctctaataatcaaacaatcctttaattccttctcttccaaatgtcatacagtaccaactgtggaccaaacaatccgactcttactgacataccttcctaagacatttgctgttgtttcaaggtactcatctttcctccccaaatacattatattctctatgtagatagagtttgccttgtacccttcacaattcctcactgctcttagcacagtactaagcacataataagtgctgataaggcacaaatatgcttaaggtttaaattataatcatgctatatttctgaaagaatatgaaggaaaagaaacaggtttctctgaggaggtaagatgtgatagaaggtagaatttaagaaagcagtgataaaggaaaggacagatacatttcaaacatccaagtcttttgatttagtggaaacataaatctgaaactggtaaaaagattacttttagaatacatttcttactaaaccaagttctttccatacagaaaatcctagaaactgcctctgtaattatctctttgatctgaagagggcactgtttgctcctgttgatagcagttacttacaaaaaaccgatctcattttgaagaatccgctattcctaatacatacaaaataactagaacaaatcctatgttatccgtagagtctaggtcagatttccacattctggaatcaagttttccaccaattaaaaaggtcaaaccatggaggagcttttaggaactgtatttgtgatctggtggctttggcctgggtgagagctgagtgaattcatttcatcagggacacagaggactcagaaggttctgagaactagtctctatattttacagaagggattcaaagaataaataaaacatttaatttaccctttatttaatttacccttaattcatcttttttaagaaaatttgctatcaaatgaaggaagaggaatgctcttctgaccatctgtccagagagacacaaccaatctctgttctccagagagacagagccaataggatgaatatatagatatatgagaggggatttattagaagaattggctcatgcaattatggaggctgaggagtcccatgacagactgtctgcaagctggagaacctgggatgctggtagtagtgtgactagtccaaatccaaaagcctgagaacccagggggccactggcataaatcctacagtccataggccagagatcccagagttcttgtgtctaagggcaagagaaaaagagtgtatcccagctccaggcaagagaaagaccaagttgcttttcctaggtttctgttctatccaggcctctagcagattggatgcccacactgaagatggatcttccccatgtattccactaagactcacaagccaatgtcctctagaaacaccctcataaacacacccaaaaataatgctttaccagttctctaggtattccttaattccgtcaagttgacgcctaaaattaactatcacaccatccatgaaggaaagatgttttgtcatctactataattatttgaacaatgtttcagatccatgggacagaatgaaaaagatctagaataaatctgatgtctttgtttctgttcttgttaactagggttttgtagtgcaggggaagataagcagcctccttcagtgctagtaccagctccctctccctgaaccacaagaccacccagtcgagggacttagccatctatgtctgtgctgcagggaacctacatgcccctgaaagcacctaaatgcaccaccccctccaccctgcattgggacctccactcaggggttagtaaaccatcttcatcacctcctctgaccaaaagaatattgtaaatgaatgtaacaaatcagagaaaatcttttctaaaagacttttagaaagctttttgttcactgtattatcagataaggaattcagagtcatgagaaccctgatcatgagctgtctgaggtgattaggaccagggaccctgagtgttctttcgtcaagacccactcatctaagaggggctgtctcaatgattggagcggcttctcccacttgtgccattaattgctggtatgcctcagtttttgcatctgtaaaaattctcccacgagaacctgagagtaggcgtgtgatactcacatatttttctcctagtttttactttttatagtctaactagctaactccagtaagaaatcccatgatggtagttgccagatagggttgatatcccaagggagcacagtaaaatttctcagactgcccagaaggggttctgcttccacaaaaaagcagccgtctgcccaccccacccgtatttgcccacttgcaagttcttttatatacatcgctttatttggtcttcaatgttcaataatttgattaactgtggaagttggaactgattgaatgataaatacaagatactaaagttctgattgcataggtcccagaggatcacaaaaaagatctaaagtggcaagatctatctatggccacaccaccccaaatgtgcccaatctcatctaaaatggcaagatccattcagcattgcagcactggaatccccagtcagcattgcagttgcaggcccagtgagcccaggcaagaggcggaaaacatttactcttgagaccctaattagtgaactcatagatagctgcagctggcctgagactgggagagaagacagcccaatcgtctggagcttcctatacagactagagagtggtggcacatgcctgtagtcccagctactcggaaagctgtggtgggagcatcacttgagcccaggaggttgaggttgcataattgcgccactgcactccaacctgggtgacagagtgagaccctgtctcaaaagaaaaaaaaagagaggagaagggggtaaattgtaaaataatagcatatttgccaatttcctgtgaatttgtccagaaaatagtaggtagtgcagaaatttaacaccacgcaaacaagaaaagtagaccacctatggaagaaactcaacatgctgtactttaagaagtcctccggagttaagaacggctgtggcaaaatgcccactgttagcaccatttccaagtggaaataataaatgggaagggagagttaagaccaccactccctatacggcaagtcagcttttaatttagtcttttattctccttcttgttttacagggggaaaagtttacataaagctgaactatacagaagccttatctaagattggatgacacaaattaaatagggagagaaaattaatgcaaatgaaactagtagttctctgtattgtgagttttcatttttgctctgttgcctcttctataaaatgcagactaattcctgacctttcctccctcaaagaagaatgtgtgcatgaggaaaaaatcagatgccaatgaaaagctgtcagatgtgcaacacagaatgttcccaaatgaattttatgttgattgttctgagtcttctttcacaaagtcattaacagaagctcacaaaagcccttgccaccagtattgtagagctccttgacacagccaaaatcaggtattctttttttaaaaaagaaagtcttcagcaaattacagtataattagatatcaaaagtctggtttcaattttctctagactatctgaatgttattgttgttgtcattatttttcatcatttctcaaagtattaaaatacaatttggtcaaacaataatataaccaatacctgtattatcataacccagagataattttctgatattggcttcaagacagaggagggaaagaaaaaaaggaaagaaggaaggaagaaaaaaaaaaggaaaaaagaggagtaaggggaagggaaagagaaggaaagacgggaaggaaagagagagaaagagagagagaaaggaaagacaataaaagcttatagagaaaactgaagtcacagcattagcttggcctgtcttttccccacccatctcattctcctatccaaattatgtctttaaaaaacaatgtatcagctccctttcctcttcatgtttattcccaaataaattacagttccaacaacatcttttttcgttaaatattatggtccaagttttattctctgaagcaaaagacaaaaagtatcgaagagctttccctaagggagacatcataaacagcccacctgacatcccatttcctgttctgaagcagctacggcaccagtgcagctgatactcaaggttcagatcagaagaggaggcttctcaccctgcagcagggacctgtgagcatggcatgccctggcttcctgtgggcacttgtgatctccacctgtcttggtaaggaaggcgcatgtattcaccttaactagtattcaatagaacagagaagtgggaagaaagattaatagtgcaagaatctaatctcttcactgggcccagctattaggggcaagaaagctgatggattttgtcagaggtttggatcaagaggaagaaaggcgggtggcaatgggaacaggcttgtgagtctgtttctgtctctcacatggtatcccagtgaagtcctttctctcctctttcccacagaatttagcatggctcagacagtcactcagtctcaaccagagatgtctgtgcaggaggcagagaccgtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagcgcacagtgagacaagcaacagggagaggcttacagaaacctcagacctcagcatctgtgcaaaggtcagggggaagtgttcagggttataggaacataaagaggaaataattgtcttccctaaagaaaaaaaaatgtatctgactataggaaacacagaggggatgtctataagctgtaatttttgaaatagtaataaaataatgaatccacacatgccttatagattttcaaagtaccttcacatgttaatccattaaacctgcataagcctgtgtgttacataggtcagatcagatattctaaggatcactgctatccagagaatcttagagcttgacctaaagctatattcttttagaattatatatttttgctttattattttaattactatctatctgtacatcccatgatcatatcaaagtcaatatatccaaaactgaatttcttaccatctccacaaacctttattttttcttcatttttttctcctcagccttgctcaagattcaggaacacaataaaagtttgctattgctgggtttccagtttggggaatttcttcaccctcgactttccagcctgggctatcagatttttatgcataccttattacattctaattataaaatggtgcaaaaaaaaacactacatcatgtcagtctcactgtttcccctctatccgtcattctttctgactttaacctggcttaatcctgtatttcttaacgttctttaaagcatcatttgtcttgacataagaaagtaaggaaagaaagcaaacgactgtcaagtaggatttcatgtactgctagtactcaccagcaaacgctaaaaaaaaaaaaaaaagaggaagttaacttctggtaatgctataattgcttctggtaaggcaacctagcaggtggtgacaattttgataaacctggtccaacagggagaccaagcagctgccatggtccaagtctccacccctatgtcttctgagaattgggagatgcctggaccgtgagaggattctcccttatgctaagggaaaaattaaaataaatgaaaaaaataatgccaacatttctttttatgcccacaattcccccaatacatctccttcactattaagccccttgtggagcattttattccatctgctcactgtgggtggcgagaggaagtttggaatgacaaacagccgaaataattaagtccaataagcaggctccagagcttaggctgggggtctgtttggaatgagtggtgagagtgactggatgtggaagagggtaaggggaggccaagaccaaactgcagaatcataattcagattgccgagtcatttcccaaacacagcagcttcagtaacgccacaccctagcccagcttagcacccaggcttctgcttgtctgaaaaagtggggtaggcaccaatcaaaatgaaaacctttctctcacacgaggaagacaccttcaggctattcaggttttgtcctcccttttacccctgaggcccatgagtcacccagacttagattcgggctagttaccaagtttcatatcaaagctcacttctttctatccttgcttctagtgctttcacgcagctcctctcatttgaattaataaataatcattaatctactctctctaccttcgattgtgtcctcttttaatatggtttagctgtgtccccactcatatctcaacttgaattgtatctcccagaattcccacatgttgtgggagggaaccagggggaggtaatggaaacatgggggctggtctttcccatgctattctcatgatagtgaattaagtctcacaagatctgataggtttattgtgggtttctgcttttgcttcttcctcatttttctcttgccgccgccatgtaagaaatgcctttcacctcccaccatgattctgaggcctccccagccatgtgtaactctaagtccaattaaacctctttttcttcccagtctcaggtatgtctttattggcagggtgaaaacagactaaaatacacccttcaaacattgcttcacatagctgtcccagtgagcatcctataataaaaatcagatcatgtacacacacctctgcctcaataaagcctcatttcccacagaaaggcccagtgattatttagaatataagtccatcaaagcggaggccaccactgtatctccagcacttaccatgcctaacagggtaaatggtcagggtcatctactgatggattaattagtctgtaccctgcttagcaactcagcctcatttgttgccatattcccatccccccaaactgtacacgcccatccgctcagcaaatgaaattgtttcctgcatctatgcctttgccagcattgtcccctcagcatggaatgcccatccccaattaaccacttgcctattatttgaaaggttcgcaaacctcccctcttctctgaatccttgtcctgacccttttgcactggtagaactgatcactttctcctttatctcctaactgaaaccctaagcatatttctaacgtggcaaatccaacaccttatggtgtttacaggtatttttcactgtctccccactaaaatgcaaactgttagttaccaaggacacagttttacccatttcaatagcaactgtgcctccaacaatctttaattcacagaaatgattcttaagttttttgaatgaaggtaattaattgatgggcattttcctcattaaacattatagagtaaaaatggataaattttctattttgttatctcctccatagttgtgttaactcagaattctgagctaactcataggactgtaaggcatgtcaaaaattaatagtaacaacagtatcatgctgataataaaaatattagtagtagctaacaattattgagtatatatatatatatatatatgcgccccatattctgagaggtgcatgacatgctttatttcatttagtagtcccaacaaatccatgctgtagctactattgatatcccagttttatatgaagaattaatataggttcaaagaggccaaaatgcctagaatcacacaatgtacgactccctgaccactggcctttttcccttcccaaagggtggcaaactgctatagcatctcagtcttattaatgtaatagacacatagaacataagaaagaaattcatgaaaacagtgctgcaccatacatgcacttgtagtcctcactttttctagagtagtaattgcaagatgagacttatttcaagtatccttattaatagaagttaaatgtaaaaataacactattaccattattgtttacataggaaatttttgcctttttaacattagtttataattatttgacctgggactatacaatattttaaacttcttcagtgcatttttcaatagcgtttaagtttaaaatgcagtctttggcaggggcattaataaatgtttcaaatgtcattttgtataactctttaaagaatacaagagtttagaagaaatttctaacctttccaagttatctgaatttccaagttatcataggaagatccttcctttgtaacttttaaaacttttttgtatatggttgggcgtttctatgaatgatgcttttcaattttttttgcttcagtgaaaaattatatattgtgaaagctttcccacataaacaagcagtttttctatagcatgagtttcccatggctacaagatattgtatttttgaaatacacctcattttacccaataacttgaggttttttttgttttttttttttgtttttttttttttcagatggagtctcactctgtcacccaggctggagcacagtggtgcaatctcagctcactgcaacctcccacagccaggttcaggtgattctccttcctcagcctcccaagtagcagggattacaggtgcgcaccaccatgcacagctaatttttgtatttttagtgggggtttcctcatgttggccaggctggtctcagactgctgacctcaagtgatccgcccacctcggcctcctaaagtgctgggtttgcaggcgtgagcctctgtgcccggcctaacttgagttattgatcgagtaaatcaatgaatacagtaagcatgataagtacattgtttccaaattggagctataataagtaaaactgtaattttaaaaagatacttgtacataaaatagtatgcaagtaagagagagcccagatcaaagtaaccgaagcaaaacaaaacaaaacaaaaatctgttggctaataaaactgaaaaatctgggttaactactttaggaaggactgaccaaatgctcaaataatgtcaccacagcgtgtctctatcgtttggctcttgtttatattggctttactctgaagaaagctcaggcccacatgatggcaaagatggccgccaggagcctcagacttgtgtcctactgtgttagtttcctcctgctgctgtaacaaattatcacaaacatggtggcttgaacaatattactttattatcctacagtttgggagctcataagtctcactgcactaacacaaaggtgttggcagggctgtgttccttctataggctctaggggagactgagtgaaatcctgagcatccctggcttctagaggctgctgcgtgccttggctcatggccctcttccatcttcaaaactagaaatcgcagcactgtgacctctaccaccattgtctcatctcctgtcaccctcatggccctcctgagccttgatccttgagattacattgagatcccccacatattccagaataatcttcccatcttaagattcttggtgaatcccattttctaaatcacattttcaaggacatttgccacataaagtaacatattcacaggttctgaggataggtggtggacattcctatagactgaatgtttgcgtcctctcaaaatttgtatgttgaagtcctaatccccaaggtcatggtattaagtggtaggacctctgaaaggtgattaggtcatgagggtggagttctcatgagtgagattagtgcttttataaaagaggccccagagagctgccttgctctttccaccgtgtgagagcacagcaagaaggtaccatctatgaaccaggaaatggccctcaccagacactgagtctgctgctatcttgatcttagatttcccagccttaattgtcagaaataaatgttggttgttaaagccacccagtctatggcatttggagtataactgccccagtggatgagagagacatctttggaaagctacttctctccttaccatacctgccaaattaacaactccagcagaagaaacaggcttcttttgtgatatttccagaaaatatcctggactgactttgcttagactgatttcttcagatttgggaaacaggcagaggtggttcctcaaggcaaagccaagatgctactagaagaggaatgaataaggatacgtaaaaataacagatgaccccaatgctattaatttatttcaaactcctttttgccatcagaaagcagtaataagctcacatatcaattccaataaaataattttttaaatcgcccaaacttacatttcaacatagcaagcaaaaagcaatgaataaaattgcttcaccaaaatatagaagctctgttgaccagaaattcagcatagacagttgttcaagataatttcaatgtgttcagcagataaagggacaaataaggactctttaagggcaaatttagctgagggatgtgttaaattgtatatttggcagactgaaactaaagaataaaaaaagagacagcttgatataactttctatgccaaacccaatgttatactctaaatctaaaactccagaaaaagtttgaaagcaacaaatatgaagtcaggaaaatcattctaaattaccaactatttaggtataatcttgagcattttagctgtagatgaaagtcctatttattcatatagattctcatatgctatgaataatagttcatttggatgtctctttaaatcaaggagggataaagacaggaaggaagaaagctggcaggcaataagagccaaagtaaagatattattttgattaaaatatactcattgttgaggtatccacaaatatttgagaacacattgaagaagtaagacaggtcagaaaatataagtatatgatcagcacttagtgaaaacagttaaagagaaagaaagagcaaaagaaaaattgcttaaagcaacatagatattcaaagataaggaattaaagctgagataaatgtgacagaaatggaaaggaaggaaaatgaagttatgaaacattggcaaaaatagctaaagaatgcagaataaaatgtcctagaaaacatttatcaaagggttatattttattagcattcagtagtcacaaggcaagaaatatgatagctataaataaatacatgagaatgtttaaggttttatgatgatcatggctttactgttcaatatatattaaataaaccacaagttatctataacacagttctgaataaaatttaggaaacgtagagtcaggtacctcaatatagaaaaatacagaaataattaaccataatgcagacaaagtgacacccagttgtagagagcattacaagcattgaaatattcagaatattatttgattaaaaaaaagctcatgtaaagataccctaagcaataccaaagatacacacacacaaacacacacacacacacacacacacgacacatacatgctatatataggaaggaagaaagcttctttattggggacacagtttacatattacctcttgtttctatgagatgctataagaaaaaatctcttaagatttactacatgggtaatatatttatatagtgtctgtgtgtatgtatagcaaactcttatatatatatatggatatcttacagtcttatagacttatatgagagtgacagtaaaagagagagagagagaggagtgtatacctatttcctctcaaaaaggccatattctggcaactcccttattccccattccctactatgcagtttgatctagccttagatttcccaggaggttctcttccagaaaagtgcctgtagctataaaataatcttcatcttggctgtttcaatgcaggattcctattgagccaataccttaccattttctttccttcgtggaactgtgctttgtcataatgcaataagttttctatgaagtatatcataaacaacagtcctacagaattcatcattggacataatatagcttctttattggggacacagtttacatattacctcatgttctatgagatgctataagaaaaatttctcttaagatttcctacatggataatttgtacctacacttgtagtttgtttttatcatatggatgaggtaattatcacaggactgattgttttccttctttacattgactgctaataagttcagagccaatgttagcttaactccaactatagaggctgattgcatatattttaattccaaatctaattcaaggtttatgttcctgcccttatttttttcttcttgatttttgtatttctttgctgttgtttttgtagatttttctgtgccttatacttttttcaaagataattaaaacagtgtgtgaattcagtggggtggatgaatgaatgaggcagagaaaaaggaaattgacatggtaggataacaaactcacataatatgtagatacatataaaaagacacacaaagaaaaaaatttctctaatatatctaatcttctttatgaatgatcccatctaccaaatagtcaagaaacttaaattttgtaaattgcaattaacaatgtctcattttattcaggtttaaagagttcctttcactttaaatattcagttcatttaagttcaattccatgttagggctgatgtaaattctttcttagatgactcagtctctttaggtgatatgtttggaattcaaccaccttacccttttctttccgtgatgaaatttaggtgataaggtgagacagttgagtgtcacctgaggcaaaaaaaaaaaaaaaaaaaaaataggcttaaatccatgcattgccttctggatcttttggtctgagcagctgagcagccaatctactctgttccctgtgtaggtacctagttatatatggattttcctacctggacttttgggattatgtgttgacaccactgctgaagccaattgtttcagccgcttgactccatctcaaagaccctcatcatgggcacttctttgtacttagcccaggactttgccaggccactagctctctcaattctctgcatctacttcctggacccctggggacttctgtattccctgcacctgtaaacagaccatggggattctagaaagtagcctctgactcatgtagccaagccttgatttttctccagcgccatcttcccacgacttaagtaagacttcccccagagacatgcagcctgcccctagaacactgtgagaggtgctctactacccagtactcttgtgctgttcccatacttatctaaatgcttctagcctttcctaacccaatcagtgtccgcccatagcagaccaggggaaagaccagagtcctgacacctaagttccttgttctgcctccatttttctttaccctctaggacccaaaaaactgacctccctctctgtcctgcacctttctgtcaaactgatgtaaaactctatgatcaagtccagctggtcttacatataatatggtaaagaatacaataaataattaagaaaaagtgttacacctgaaaaaaaccttacttttaaggcagttctcttgttaagtaatcaaagatccaaatttagatgtcagagctgaatattaatgctttctatttccattcctctcagaataatctaatctctccccactcaagacagatagattcctcagaagaatatagataaggttatgtatctgaaaatataaaggagaaaagaatattaatacatttcaaaaatataatctcaattacaagtagagggaggaaatattttatatcaccaagggcactcattggaaaatcaccatagatattttcaaagaaaataaaagacttccaaaatcaaaagaaattaagaaaatgaagaaaagacaagccacagactgggagaaaatatttgcaaaatgcatatgtattttttaagtggtatccaaaatgtgcaaagtactcttaaaactcaacaataagccaggcatggtggctcacgcctgtaatcctagcactttggtaggccaaggtaggcaaatcacctgagatcaggagtttgagaccagcctggccaacatggcgaaaccctgtctgtactaaaaatagaaaaattatccaggcatggtggcgggagcctgtaatcccagctacttgggaggctgaggcaggagaatcacttgaacctgggaggtggaggttgcagtgagccgagattgagccattgcactccagcctaggcaacagagcaagactccgtctcaaaaaataaataaataaaataaaataaaacaataagaacatttaaaacccaatgaaaaaaatgggcaaatatctgaacagacacctcagatctgaactatctgaactatctgaacagactataaacaaagtatatagatggtaaagaagcacatgaaaagatgcttaacatcaaatattactagggacttgcacattaaaacagtgaaatatcactacctgcctatcagaatgactaaaatccaaaacactgaaaccatcaaattttgtgagaatatggagcaacaggaacccttattcattgctggtaggaatgccactttggaagatagtttggcagttactcataaaactaaacattctcttaccatatgattcagcaatcatgctccttagttttaactcaagtgagttgaaaacttctgtccccataaaaatctgcatgaaaatgtttgaagtacctttatttataattgctaaatcttgaaatcaaccaagatgtccttcaacaggtgaatctatcgacaaagtatggtacatccatacaatgaaatattattcaatgataaaaagacatgaccaggccgggcgcagtggctcatgtctgtaatcccagcacttcaggaggccgaggcaggcagatcacctgcagtcaggagttcgagatcaccctgggcaatacggtgaaactctgtctctaccaaaaatacaaaattagctgggtgtggtggcacatgcctgtaatcctagctactcaggaggctgaggcaggagaatcgcttgaacgaggatgtggtgagccgagatcatgccattgcactccagcctgggcaacaagagtaaatctccatctcaccaaaaaaaaaaaaaaagacatgaccacaaaaagacgtggaggaactgtaactgtatattgctaagtgaaagaaaccaatctgaaaagactatatactgtatcattccaactatataacattctgaacaaaaacaaaactatggggagtgtacactgatcaaagtctaatgtaaattatgggctttagttaataacaatatattaatattggcttatcaattgtaacacaagtatgacattaatgtaagatgtcaataataggggaaatggggaggatgagggttgagggggtgtataagagctctgtatttccactcagtagtaatacatcccatgctagtcttaatcttaaaaaggaaaatatattctagttgctgtatttcacaatgctatgatcattccttgtcttacttagttcattaaagctgccataacaatcatagactaggtagcttacgaattacagaaatttattctcagagtctggaggctgggaagccccaggtgaagacaccaatggatttggtatctggtaaaggcccatttcctggctcataggtgacattttctcatcatgtcctcacatagcggaaggacaaggcagctctctggagcctcatttataaaggcaccaatctcattcatgagggctttgccctcatgacatagtcaccgcccaatggcaccacctcctaatatcatcactttggcaattaggtttcaacatatgaattccaagggggaagacaaacattaagattgcagcagtcctttcttctctatcaaatccttgcttatccatctagatcctcagcaaatacaacttagactatatagcccataatgatctactttgctaatcaactcacatacaacttcttgactctgccatatgggggactttttaaaacattgacttatatttctacttaatcgtgtacaggtttatatgtgtcaatattcagaactatgatttacacacatagaaacatataaattaaaccaccatcatcactcccaatcatacacacacatgttcatatacagcatccaataaagcatcctattcaaatttggtaataaataaatatttacttcttgaaagatcaactggctaaagaaaataatgtattccgattcatccactttcccaaaggagggttctacacaacaatcactagtgtgtgcctttggtcacacttttaagtaacagtaagcaatgaaaaaacaaatagaaaatgccaggctgctctcatttgcactcctgcttcatgtaaatgctttcaattattcatctagcaaaccacacacacattgcaaatgcctaaaatttccttttgccaattagaggtaaacgcagtccccaatttctatccatagaagaattaaagcaattctatttgcatccaatgtaaccaaaagttgcctttctcaaaagatacctatgtggcctcaataatccagacaaaaggctcactctctcagtgtggctgctgtacttcttgcctcttgtctgtataatctactgaaattaggtaccacagcactttctctccaacaaatccatggaaagtaggaaaacatgttgaactactccaggactcccaaattcaggttgaaattttctttcaacatagaagtagaaacttctggtgaaagatggtaatagctcagcaggaagtcagcacaaacctctaaaggcaaagcaggaggccggagtcctcccctctctccctccctcataaggagccctgctctggagacttccatggggacaagagagaagaaatcgttttgctgctcagatcctaggattgagtgacataggaatggagggcccaaaaatttgagtaaaattcctagacttggtttctgaaactatcctgactctaagattaagcaacttctcttcttaaatttcttcttataaatctctccttggggaacgttcctgggtggataaaacctatggaagaggggaaacagagttgtggagattaaagttaaaataaaaaaaagtctttttgttttgttttgtttaatcctattttctcattatttatctgaggtaatcaagatccagagaagtccctcccttgccctacatgggatagcagggggttccgcaaggattctgtcctcgcactgactcccactcccagtctgtgtctgcttttcataccaaacactaaatatgttattaaacaggagaataaaagttgtgaatatcaccctggcctagacagaaacacacaatatatacaataccatactataacagatattctactagatatgagagagccaatacaggctaatgaagaaacaagaggaaaagatgaaaaaaatgacatctagaggtattcgtaaaataaaaatctaataggtaagtaggcatgagttaatctgatctttcctctaccccaaattatttttctgccccaccgtctaggctagaatgtctacttcctgcttctgtgcctatagtcatcttagtctttgtctaagaacttggtcaaaccagaacctttaggtattgtgactccatcagttaatccctatggatattttgcttcttagtaacattctgggataacatttgtagactgctttggttattaacaaaaccaacaacatggagctttaatgcactctctaacttgagttctttgtcttgtctcttttacagctgcgttttctctgtgacaccaggaatcagcatttccattcaaatacagcaaactttaaaccgctttttgacaggaggaaacactttctgcctaatgaaggggatgaagcaggtaacccagagagtatctgccacacaggcctcctctacagtagctcagaattgcactgtttgattatttcttacacgtggcatctgcaaattcagaaaggtgagtgatgtcagatctaaaggtcccttcttccatcttggttcattcaaattcaggtctaagaggaaacattgaagaagctatctgaatttcaacaggactgattactttccaccaaaggctgtaggagacacagatttaaagagtgactagggggttaaacataaacatatattgacagtaattcctgcattgtcatcaaagtgtgctcatgtttgtaggccaactcttagtggtattcagacattggaaaactgtaaaaccttcatgcatttttaagatgacttctaaaatattttattattagtttaaatgtttaaatagctacaaaggttgtaaattccactgtaatataaacattgacattttcaaataaaactcagaatagcttttaaacatatccagtgaaaccttaataccaaagtgatttgatacccatcaacacccagttaaaattcacaacaagctcttcattgacaattgaagaccttatattgctcttttctttccttggaatcatatttccattcaacttctcctgcagaacttaattttagtatatttttgtttaaaggcttttgttgatcacccaaaatgcctgcaacaaaatcacgtaaaaaattgaaattgcttttaaattttctctgaccatactgctctaattgctaaaaattatctttctagattgagttataaatataattattgttgatgtaccttttattaaaacaacaaaaatatatttcaattttagttttaaacttacaggcgaaaattttttggaaatgcatttcttaagaaaatcactggggtcggcccggcgcagtggctcatgcctgtaatcccagcactttgggaggccaaggcgggtggatcacgaggtcgggcgattgagaccatcctggctaacacggtgaaaccccgtctctactaaaaatacaaaaaattagtcgagcgtggttgcacgcgcctgtattcccagctactcgggaagctgaggcaggagaacggcgtgaacctgggaggcggagcttgcagtgagccatgatcgcgccactgcactctggcctgggcgacagagcgagacactgtctcaaaaaaaaaaaaaaaaaagaaagtgactggggtcatatttacggttaattaaaggaggcttccttgacaccaataaattgtccctttgtttaatgttccaggggtgtttaaactgcagggcaatgctgcaaaaggagattccgtcttgaataaggttggggaagagcaattatgaaatttgagacgggaaacaagaaccacagtcaagctcttgaacagatcacttttaggaaaggttacatacagaagttgaagatctggaaattgattcccttaaaatacataactgttgcctagtttgaaaaatcactgcattagattgctctccacattactgatttcattctcagccagacttcatgaagtggtgaggtttgaggaaaatcagcaagagattttaatgacagagccttgagtttcagtaaacctgataaatttcctaaaacttatttgacatttctggcttgaaagaatagctcctgatgaattagaaaattatgggagattgagttcttgcatgacacaaagtcatttaaacatatatctttatcttgggaaagacagtttaaatgtcatggccatttattaataatattgtgaaaaaaagttatcccaatcctggaaaaaagaaaaatgatgattgctagtctttttttttctctatctgcaagagcattttcaagtaagcaattatctggcattcttggggatcgtaactttgttgtcagagcatatttacctagcaatccataactgagaaaaggctcacatagtttacattcctgtgggttggaggttaacctacagaaatggaagagttttgcgttcatagcctggaaaaaaaaattaaccccagattatcgtgtcaaccctaatagcattttattttgctatctatatagttgtatctttttcctgtaaacatttgtggaattagctttttttagttaatgattaagaatagtaacaaaatgtgaacccaggctcactccctatttgtattagtattttgttttttagcacatttaaggccatcctggcactaaatcagaaaactacttcctgatacctaaactataaaatcctggtttcatatacatctgaattaggcaaaaacatagctggctattatttatttaatttgatgtcttaacatgtaaagattttcttttcagaagaaatctaatggaccagatgtcctgaaacactcttaattatttttcagtagtacgaacatagccatgaaggcaaaggaaggtagatgatcaattcatgttaagagtttcaaattccatggactaatttatatctttctccacagccacctggcacattctgcctttgaacagatgctttacaaaaacataatctgtggacatggagatcttgcataaagcaaattctctctgatccacagcttcactgaggggtttcagttttctaggccagagtgactgctggagatgaagagattctatcaaacgtcagtgtaaaattgtctcttacttaaaatgccctcattgatcttatcctgatacccttactacagaagtttatcatgactcatctaggagataccagagagttcactagccaattcaagagcatgacttctcaaaattctccatgttttcctctttccttcctagctaatcccactttctcctgcctttgaaggctatagcttctctgccaatttcttgaattatggggttcctaagccctcttctatgttatccacagattctaggcaatcttactggctcctgagcctcgaataccatttaactgctctagactgacaaacctgtatctctagccaagactctccttggcacagacacactattgggctccctatctcatcaccccataggtccaccttctctgtgtccccatcctagtaaacgaagccatcagtgcctccaacatgttctcttcagtctagccagagttattatttaaaaatacaagtgcaatctgtttgctctcttgcttaaaactaatcagtgacttccagtttcccaaaggatggaatcccaaatcattactaaggctcacaaagcctttctttctctagcttattgctctggtttcatctttcatctttattcttcacccatcttgcactctgtgcttaatatctcctgtttgcttccaggtcctctctccatccttccacaccctgctttgtgccccaggtgactgacctatagggattataccaataagctatcttgtcttttggtttccagtaggtttttgcccaagggcagtacccacagagaacagaaaaaatgaggaaagtaaggtcaggctatatattcccccaacttcctcccttcccacatactgacattaacccacaatcagctccttacggtggcctctccaaatagcctgtctttctccaggttttggtaatcactccctcctttccattcaaggcctggagtgatgctagtcccaggttgtagcactatctcttatatgttccctgctcactgcttgtatttttataactagtgtcatgtttctcaaattacacaatttcagtatgccataagtttcctaccagaacccagattgatactgtctgctttcaaatcctaaaaggtgtcaactatggcttaaatgttccttatttcgggaggccttttctagccgtcttgacttggatgtaaccgcctgctaaacctcctacagcaccctgtccatctcctgacagaacatccttcacacttagcagcaatcattgaatgagtattagtgtcgccttctctaaacaacaaacaaactgtgtcagaaaaatataaagcaaaatttgtaggaaatataaaaataacttgataacatattcattatgggacaccttaatatctttttctcagagagagaaagagagagaggatgatggaaaaaactttatattaaacatatagctacagaatatttacaaaaaaatgagcatataatatgactcaaaaaatgggaatcatataagccacattgtctgaacctaatgcaataaagctagaaactaataattaaaagatagcaaataaatgagtagaaagagaaccacttataatattctaaaacattttcaggtcaaagaactaagagttaaaattacacgtcactaaaaatgaaccctaataatggtactacataaaaaaactatatatttgttcaaagcaatattcacaagaaaatgcatccatctattaataaaaagtaaaacaaaggagccaaatctggcaattcaagaaataaaaaagaaatgagcaaaataagccaaaacagagaaggggaaagtttaatgataaaagcaggaattaatttaaatgcaaagcaataattagaatgtacaaataaaggcaatatttctaggaaaactgataataaaaaagaaaacacaaatgtgcaatgttaagaacgcgaaaggtgctataaccccacaaaaaaaagcaatttttcaaatcactggttaatgccttgtatacatagatcttgatgaaattggtggtgtttagaaatatataactttttaatttaaacttctctactttctaaaaatttatactattttacaattccaaagtcaacatcaaattgtaaagaaaaaaatcctgaattctgcctcttcttccttcttcacatacgcagcaaataaatgctacacatataccaactactatgtctcgactctcctatgttttcatcattaaagaaaaaaacatattgcattcctactatatgccaatcattgcactacacactgggaaatcaaaaatgactatgagaaattccctgctttcaaggagttcatagtctagtgcgagaaacagacagatgtgcacactgattataatactatgtggtacctgtgataatgcataataatgatagatgtctttactgagtttctgctaagtgtcaaacaccttccattcagctgagatcttgtcctttcctccaactcttacccgggcattttcacataatagctcgttatcatctcaatttcaaaacactttttgtactcagatgcttctccaatttcccagtttctgtaaatggcaccacaacatttccttattcaggcttgaaccttttgagtttatagtcaggtaccaatgcttgtcagtttttcctttgaagtgctattgaatgtatattttgtttagaattcccatgactaccaccttattcaagtccttagattgttcccaccaagttgaaaggggtgtcctccttcctcttcattattgaagtctctttcttgctcttctcccctatcctaccagctcccaaccaccctctgaccctctgcaccactgccacacctttctttttaagatatcttttcatcatatccctccactattcacaatcttacaacagtttctattttctcatgaatataagccctttgaagtagctttcagtgacttccattatctcctcctcatttcaccaatttatcctcattcccagacactattacccagactctgttttctctgttagctggaccattcttcacactttctcaaagacatgtcatcctcactcctacctctctatatttcctgaaatagcctttagtgcgtgctctctctctctctatctaaacattatgtgttttttaggccttagctcctccaaagagattgtactaaattcccatagcctttcataatttccctctcttttgacctcacgtacagcatacacaaaaaaaatgcacccaatgctatgctactgtacaaagcagtgtactgctttgcactgttaactttaactctatgtgcattattttaatctttctaactatcttacaactccattaaaaccaagactagatactgtggaattatttaatacccccacccacctcatcatttatcacattacttgatacttggtgagtacttgctgggtacatttgaatgtaatgtcttttatttcttaatgtctttcattttctcaagtgttgttaaaggcaaaaagcaatgttggatggttttatcagttatgcagagttcatgcaggaaaagagatttcagtgggaccttgcttaagacaatagagaatttagtttaggatttaacaggtctagaaattaatgtagaaagctgtcccacaaagatctattatccagaatatgtaaggaacctaaacaattgaacaagcaaaaaacaaataactccatttaaaaatgggcaaaagacctgaacagacatttctcaaaagaatacacgcaagcggccaaccaacatatgaaaaaatgctccacatcactaatcaacagagaactgcaaatcaaaaccacgatgagatatcatctcacaccagtcagaatggctactattaaaaagtcaaaaaacaacagatgctttcaaggctgtggaaagaagggaaaacttacacactgttgatgggaaggtaaattagttcagccactgtgaaaagtagtttggagatctcgcaaagaacttaaaacacaactactattcaacccagcaatcccattatggggtagatatccaaaagaaatcaaatagttctacccccaaaagacacatatactcccatgtttattgcagcactatctacaatagcaaagaaatggaatcaacttaggtgcccagcgatggtgaattggattttaaaaatgtggtacatgtacaccatgtcatactatgtagtcataaaaaagaacaaaaccatgtcctttgcagcagagtgaatgcagctggaggccattatcctaagcaaattaatgcagggacagaaaaacaaataccctgtgttctcacttagaagtgggagctaaatattgggtaaacatggtcataaacatggcaacaatagaaactggggacaactagaggaagaaggaagggagtggagcaagggctgagaaactaactttcaggcgctatggtcgctgtattagtcccttttcatgctgctgataaaaacatgccaagactgggtaatttataaagaaaaagaggtttagtagactaacagttccaagtggctgggaaggcttcacaatcatggcagaaggcaaaagacacatcttaaatggtggcaggcaagagagaaatgagagccaagggaaagtggaagcctcttataaaaccatcaaatctcataagacttattcactaccaggagaacagtatgggggaagctgcccctatgattcaattatctcttactgggtctctcccacaacacatgggaattataggagctacaattcaagatatttgggtggggacacagccaaaccatatcactcactatctgggtgatgggatcatttgtgccccaattgtcagcatcatgcaatatacccagataacaaacctgcacttttttaccccctgaatctaaaataaaagttgaagggaaaaaaagaaagctgttccacattgattgcagtgagtataatgggcaaaaattactgcccccaacccgcagcccccaaatcctaacagaaatctgttacatacacacagacaagcatggattgagcattagctcagtagacaggtcggttgaatcccactttccagctgcatgatcataaacttattgtttaacctctgtaagcctgtttattcttctgtaaaatatagatcttgtgagaattaaatgagattatgcattcacttagcatagtgcctggcatacagtacagctcaatacatgttagttattattatcatcttttgtcctttcttccacaactttgtataagaagtgttggaggaactgaagaaaatgtgatgtgttcaacatggtacagaaaaggtacaccatgggcagatggtcaaggtgagtcatagactaacccagttcacaggagtagctactcatgttagaggagtcctaaagaaataaaagccttccttccctcccactctccctccatcaatggtccacagagttgagagaacacaactgtggtaggcatctaccattttgttcacttagaatggcaactcattcctggtaaaatataaattctaaccatgtgttatgaatggagactgctatcttacttatgaatgggctgatgaatccacccagaggtggatgcctgacccagctgaaccaatcatgttatgtatacaccactctagtcacaaattgcccccctggatgggaacctggctcagactgaagcaatcaaagccttacctcaatatttttaaatctgggatcagaaaggatcctcagtatttctttggtggctacactgtgagatgaatcccaaccaaaaaatgtttacaatcatgcctcctgctttgtggtggaatctggtctgaggaatgaaactaagacacgaatgaaaggaaaagtcttaaaggattaagttccctggcaccctggatgcctgaagtccagatacacttctgctcttgccaaggttattggagtcagtgcatttctcttcttgcctaagcacatttgagttacatttctgtcacttgtaacatcaatgagacgttaaagagttaattcactaggaaatttttaggaacaccttgctggcttacaagaagcatcaattctacgaattactttctcaggaatttctctaaatatcctgaagagggcactgtttccattcataacttctgtccaaacccacccccattcttttgtttttttttaatttttctttttatttcttttttttctttttcttttttttttatgaaagggagggactgagtaaattgcaggatgtgattctaattggttggaacatcttttgaaatcgtgtttctgtagagaaagaaaaactaccatatttggatagccctggccaactttcaaggctcctaaatctgagttttcagtgaactggacagaaaaaaaaaatgaagaagctactagcaatgattctgtggcttcaactagaccgtgagctgggggttcattgaaaagggagccatgggaggaaaggaattgtccatacaatgtttgggggtagagacaaggttcaatgcgactcatttgggttccctcgggaggaacaggattattggggtaaccagtgaatgcttccttctgaaatgttctctttggacagggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtggacacacagtgctcccctgacgccaccagtctgtacccaaacctgcagctggtgggcccactcctcctgcaggaactatgactgtgaggcttcgttcactgtctgtgcatttctttctgcaaggaaaattctgagatgggtgaaaaaagatgctgttttatcttcttaactgtggaatattttttaaaaggaaaatgtattcaggctgagggaagattcctaaccatgtatttcctgagaatatgaggtctcattctttactgcctcacagtcagaatttgttagtcttccattatggaataattttacatgtagtgcaactgtcacaaataattcctatgaaatatggaatcattatttgttttatatatgaatgtaacatatggcatttaccaatgaaagaaagaataaatgctttataaaagaatggtctatgtgaggttccttacctagtgtttcctgctaaaatactgactacagtagtcagataatatccgtgtgatctaagtacctgtttatctcaatgtgtggagagtctctgggaaatgtatcctttggctggatttactcgaaaactatctgagggtccttgccaaccagaagaatattatattttttcttgtattatttgccagtttcctcttctcctccctccatttttttttgtaattgttttgctacatggtagaatttatattaaactttatttgcccattgcagactagataaaatgaatttcactttcaggaaaattgtcttataagaaatccccaatttgaatgttatacaaaaataattgaaaataagttttcctgtcccactaatgagataatcagtaccttcagatatcaattgcatcatattttcatcccagacttctaggaaaataataaacttgattcagtcaggcttttaagtgacaatatttcagaaattaccattacaatgtaaaagctgaccttaacatttcaacatttgtaccttcctaagcaacagcacctttaaaaacatttaaaaactaaaaacacttatttctctaaattgcccctagagtctttacaagcgaatcagcttctgcagcaatttgttggcagattatgaaaagtcagccacagcagtgtacagaccaaaagctcctgctaccactcagagcctccagcagggactataataacttccgtatttagataaaataaaatttgacatgaaaaaccgactagttccatcatcctttgagtcaagcagaggtttcactctgacagagtaggctgaaaaaactttgaccttgtatttataaatactcacaacgtatcttaaatttcaagtttcttgatctgttaccaaagcaagtttccttgtcaatgactgattgtcgggaaatttttattttgcattgatgatcttatttgttgtgttgttacataatcagaaaacaggatgttacatcagattttctatatcctttctggagcatttaacagcatgtcttcacacactcatttccatgctgaaaacattttcaccaggaaactattcatgacggggaaaaaaatattgttcaatccaatctaattaactgaaggaacaatattgacttaagtccccaaatctcttccttcttagagagaactcttggattctgaagatgaacttttatatcttcttcagatcaagaatataaacaaaccctaaaacaaatgaatagaactgaggatttcattaatttgatctttagaacataaaaaactaagttctttccacttctccttcccaattttcctgactccttcccaacttatgagtatatagattttttgctttcttttcctagaatcacttactgtcactgaaaatatatcattaaaccttattctcgaagaaacaatacagacattcaaaattgaaccagttgactttaagggtgtgatggtgtagtaagaaaatactatcgaaggtgacaatctccaatacattagagcatgctaagccaaatatgttttcccccagtaggacctttaggaatgtctcaggtgactccaagcttccggcacttgctgtccatgaccagagcttctactaacaagaagttccataaaatacttggatccatcctaatcagatacaccagttgccaagtccacttaccacagagattaggaaaggagacatttttctcagttgtgctattcatgtcccagaaatggcatttaagacaaataattctttgagtatttcttccaccctgtctcatctgttttgatgtgaactagtctcttttttcattgcttttaacacagctggttattttttcttttaatagtgtgtctgcttcaaggtttatctagaagttgtttcttaatatcaaaaaagttaacattttttatttttactgaattatgaaatctaagtgtaaatatgaggtgcaccttctaggaatttatctaagactcagtatgcatgttcttccatctctcccagctacctggcctcccatcccctttcctgctggacttgttgatcctcggagactcaagtacatccttcacttagtctatgcactatataccttcttcaatgaggtccctgtgtcagggacatggttctcagtttccagctactttccatgagctccctcaagcaagcaaatatttttagaaggtatttttagaagacaacattttaaaagaccatagtgtcctttctactctactgtgtctgcaatatgttgcagtagaacatttcacaaagctagatcttctcagagctccagatgggaaccaggcaaaaagctctctttgcagcggacagtcaacctatcttgtggtttccattgtccgcattcctagctcagggttttagataggatttgtgattttttaaaactgccctgaaacctcaggctctgctcttgacatataaattatcaaaaagaaaaattaccaagtacctgtctcttgcaactcaaaaaaatgccttatttcaggatattttttcctcctaagactttttaagtccattttgaatacaaaatcaataatttgaccctttgatctcactggatcctttcacaatctccctttactggagcaataagattcatcctcaaaatttgtggcaagagatttacaggggaaaaaatgaattttaaagaaggaaattatcatatttgaaactgttagtccactccatttagactcagagattctaataacacaacagtgtgaacaccagatttggttatcagaaagaattcctgagtattcaaactcttctactgtgagctctatgcccttaggcaagtttcataatgtatttaagcctcacttttctcatcaaaaaaatatggaaaaaataataaccactttctaaagtttttatgacatttaaaatgagatggtgtatatgtaaagtaaacagcacacacaccagatcttctagaacagtgtttactagagaaaattcataaagacaagagaaagagcaggtgtgtggtttccccagaggcagcactcaccctacattctgaaacagcacacagcaacctagcatggccaatgtgagaccctaagaaagagaacccagtcttgagccatggaactttaaggctgcactggggaagcaccaggccttactgtagcatgggggctgggctccaaattatgtgattatagcaaaatcaaggaaatctgcaacctccagtcctgatctgccacctcagctctcttacaaaatttattgcctcaagtgctaggctggggctctattagaaccagttccttctctggaaggccaccctgcagggaatccattacccttacctctcagtatgtgaaattcactagcacagagcctggcatgtagttggtataaatgtggaatgaatgtgtgcagccatggaggacaatgtcttcagtccctttgtaatgcagaaagtgtgcttgttctcagatcaaataattaacttattgaacaagtgtttataggtatctactaggtaccaggctgtcttctagacacttgaactatcttcttttaaaaaatgcacgaagatatcagattttatagaaaatacattctagtaagcattaaccataagtaaattactatatggtttatgacttcagagagtctctttagcgttaatatattttgcattacaatatatgagaagataagtcggacgggcgcggtagttcacgcctgtcatcccagcactttgggaggccaaggcgggtggatcacaaggtcaggagatcgagaccatcatggctaacacggtgaaaccccgtctctactaaaaatatatatatatatatataaaattagccgggcgcggtggtgggcgcctatagtcccagctactcgggaggctaaggcaggagaatggtgtgaacccgggaggcggaggttgcagtgagccaagatcgtgccaccacactccagcttgggtgacagagagagactccgtctcaaaaaaaaaaaaaagaagataagtctatggagacaagaatcagagcaagttaggggatagggaattctggagggggccacagaagggtggttcccttgtaattttaggtaaagtgtcagagtagcctcactggaaggataacatttgagcaaaattgaagaagatgagagagtgaatcttgcatatacttggagcaagttttccaagtagaggagagtccggtcctaaattaggaaatgcctacatgttctagaactaggtggaatgagaagccataggaaggctttgagaaaggagtgataaaatctgacttccatgtaaaagtcttactctggctgccgtgctgagaatagactgcagatcatcaagatgaaagtggggaaaattgttgtattaacattaaaaccaaagatatctggtgttactctgagctcagaggcttcttccaccagaaaagctcattcaagagcagctgttgttactgctcctgctgatggaagaggggctaaagacatatttgatagcctttctgtagatctcttgactgcagatgacctgtgagtttaggggaaaatgacaggaaggagtcttaatttcagacacaagaaggtctgttgtgaaggcatcttccaaaaggcaatatttgtgctttcttctgttgtgtaagactccctactcaaatttaggcagtttaaggaccttagaaaattgtgctgtggtgataaaggtaatggaagtcagagcagagggataataaaaatccatatgcctctttgaaagcctgtgtaataaagatatctgctgcctcaccgatctgaacagggttgaataagcaacaaatggacaagaatgctcagtccctgagctaccaggagacataggcctttagtgggactgcctatataatttacgggacccagtacaaaatgaaaatgcataacttcctaagaatttgaagactgcaacagcagagcattaaagcatgagttctatgagactgtacaggtttcatacccaggaagctggccctgatcactactagtttggaatgccatcattattcagatatcgatgttacaggcaggagcatgggaaagaccttaaattaatttgataacaattcaacctagtggcatacagaatgagggcaaactaactgagtagtttggtgtagaaaagaagcacctcacctcctcaaattacctctgagatggtgagatgccctgtccttttgacatctacatatttaatataaactcttcacctaggaccacagcagtggcagagatccagatgctcggagagatctatttgcacaagaaaaaatatgcataaagaggttaatagtcaaaccaaataaggggctgagttgtaccgtgagcttttttacaacttcaaagtgggaaacatttattgcccttactcatggtgctgtctaaagaataactttttactctcctgaacatttcagggttctactcttattagagaaattgtactattatcattttatttttaaaatatttttagaaatgggggtctcactgtgttggtcaaactcttgagctccagccatcctcctgcctcagcctccaggggagctgggactccaggtacgcaccaccccacccggccactgagtcactattaaaaatcatttagcatagcccggcctggtgtggtggctcacgcctgtaatcccagcactttgggaggctgaggtgggtggatcacctgaggtcaggagttcaagaccagcctgaccaatatggtgaaaccccgtctctacttaaaaaaaaaaaaattagcctggcatggtggcacccgcctgaaatcccagctactcaggaggctagggcaggagaatcacttgaacccaggaggcggaggttgcagtgagccaagatcacaccactgcactctagcctgggtgacagagtgagactccatctcagaaaaaaaaaaaaaaatcatttagcatacccagtctggggctttctactgagagcctttgttgacttctcttctaaggcaaagagcagggatataaagaagtaacacttcgaaagatggatgttctagttacatttctaggctctgaaatcaaatacttaatccacttattgactgattaatttatccaacaaatattaaacttgaccgacccttatagtgtctggagcctagtaaataactattgaataagctgtgaacagacagccaagtcctgcggactcagagaataatgagacaaatcagatattgaatcctggcttcaccacttttgagcagtgtgacctggagcaatttgtttatcctctctgatcatcaatttcctcatctataaaatgggaacaataatattaacacctattttcacaatcatgtggattaatgtatgcaaagcctctgtttcatcactaagcactcagtaaatattagctatcatcatcatcattactaatttctattgatttaactagacacagaaagggcagcatgtgtcttacaagccagcgcttccctcttctaaccactaattcaaaaaggattgtaagtaatgtttagaggtcactccctagcccaaaataggatgccactgtgttgtgctttgttttctttcttcctccagtgctgaagcacttgtgtgttttggttaatctaagatttaaaagattcctacatgtagtcatgcaaagtacttgtatatacctctaaggacctagcaggtctagtgatcctggagtctcatatccgaaagaggaaccagtactaaaagacaaacttcccaaaatctaaagaagggaagtgcaatcaatggtatgagttagaagcctcaatcctgggagagacagcctgtgcaagccaggagaaatcatgggttctccagtccccagcactggagcagccatgatcagtgcctccacttcaatgcttgtgaggctgttactctctggtgagcaaaatgacagtttaaaattttggctcttttataatttctcttatttctcattttgttacttagattcaatgtcgtttccattcattctaataagaaccttggctttccaggaagaaccactagagactcagtgaattagacacagggctatgtgaccctttcttcaggggcacacctgacgttgaactgtacctacagaatgggtaggtaccttcctcttgtggtatgtccaatatcccaaagagatatcaaaatgccttgtctctgaggcatcatgataaatgaaaaggaagatttcaggcccattaagttaagattaaaacctctttccacttgcagaaaacctctatccaagcactaggcacaattgtgtacttttatgttcctaatgacacagtaggggagactaacagaggagttgagtgcaaattgcaaggggtatgagaggggctgggtgtgagcagtttctttttcctatccagacagggccctggagtgcaggagtgtatgtgggaagttggacaggcttcgtgatttgctatcccaggttaagtagcacatgagactgcatcttagaaatggggaaaggaaagatttgtcaaaacattgcccatatctgtcctctaattatagctcactgatcaaaactacaagcctagtaatgtaacgaaggaaagttctttgacatcagttatttaaaatatgtacaatgtgattttctgaaatacctttgtatttaaaatgtaatttaaattacccttaaaattaaaataaatcaataactgttttagtccattttgtgctgctataatagaatacctgagaatgtgtaatttatgaagaacagagacttatttcttacagttttggaagatgggaaatccaaggtccaggggcctgcatctggggagggccttcttgctgcaccatactatggccaaaggcagagggcaaaagagtgcatgcaagagggagaaacggataaagtgccaaactcattcttttatcaggaacccactcccaagatatctaacccactcccatgataatgtcattaatctattcatgaggacagagccctcatgaccttttaaaggtcccacctctcaacactgttgcattggggattaaatttccaacatatgaactttggggggcacattcaaaccataacaataataaaacattaatattcctggggaaaatgagcaattcacaaaaagtagtacaaatggccactttataaagaggtatataaattctttagtcatcaaagaaacatttaaaaaagtgattcattttttccagctatcaaaatagtgaaggttactgacacacacacacacacacacacacacatatcatggaatttttttctgttactccaagaacctcctatggcaccatgagtcttgagccatttactatgtaaccagaaataaagactgcaaatactcaactgtaagccaagccacttctagtctaagtgcaagattgcatatttgaagagaaatatttccatttctgagaaaccagataaaattatgccaggactgaggaagaaaaaaagagaaaaaaaaaaagagcagtcaggaaaaaaaaagcagtcaaaaaaaaaaaaaaagaacaaagttaagtagactttgcaaaatgacttcaattgaattacaccatcattatcaaataaatcttcaagtccagataaaaaaggaataagtgtaccctcagcactacccttttctagaagagagaaccaaaaatatcttgattcactaccgttttcagtgaagaatattgcaaatgtgaaagatggtaataacaggagcaatcaaacaatagacagtcctgagaggttactgctcttttactgtaaagctaaactttgaaatgtgaatgctaagtctttgttaacacaattataataataattacattttagatagaatttcatatttattcttgcattgttgaagttaattctattttttgatattcagattcagctttagcttcccccagatattgactttaacatctcaccattcggcatttggtcacaatgtgtgttcagtggaccatgttttaaggaaataattagacgtatgaagagggtttatgtaagcatagatttatcacaatgttgtttgtaaaaactgaaaatattgaaacaactgtctaaaatactgacatgttgtgatgtctaagttctagtggaaattattctcccttagaataagtgttgtagcgataacagacttaggagtgtggtgagtcccctttgcacaaaaagaccacctcacacccaacatgactcttaagaatgaggacagtagtgaggacacactgcagaacactgagaggcagatgacgtcttataacctgttcattaacttgccacttgggggtgctattcaccagtgaaatcataatttatgcatgaattctgagtacaactgtgaatcctcacttcaacagtgatgccctctgctaggccagagacactaacaatgaactcctctctggactttctaattctgatcttaatgtttggtaagtacattttattaaaattttttgtattatttcaaaataataaatacttctccaaaagatacaacaactctggccaaacccataaaatcagtacttttttccccctacaggaggaaccagcagcaattcagtcaagcagacgggccaaataaccgtctcggagggagcatctgtgactatgaactgcacatacacatccacggggtaccctacccttttctggtatgtggaataccccagcaaacctctgcagcttcttcagagagagacaatggaaaacagcaaaaacttcggaggcggaaatattaaagacaaaaactcccccattgtgaaatattcagtccaggtatcagactcagccgtgtactactgtcttctgggagacactgtgttaaaagcacagtgggagctatacaaaaacctcaaaggctcagaggaagtatgtagtgaggctggaaaacccaggttgtagagccctgttctctctttcacagacagtcctgttaagacattattagaagataaggaaaatcaaaatcagatataactgcctctaattccagggggcacaggggtttctttgacagaaaatggggtcagggaagagggtctcagatgatatccctgctctcaattaggtcagttctctcttgtccttcaggctttcttgcatgatgtgtaggaattagaatatgatgacttggatgtcagtcctggctctactacttattagctatgcaaatttggccaagttaattgatgtctcagagctttagtttttttcacttgtgaagtagaaataaaaataatcacacaaatttagcatggagataaagtggaaaaaaggtaggttaggaaggggcagattagtactcaaagcatttctggaacttgcaagtcccaccgtagcagttctgctctctcacagcaatctctctgcctagtgctgaccatcctaacagggcttggcatgcccactgctttgtcacaccacaccacaccccacgccacgcccagccccaggccattatgatcaacatatcatcttttctctcacaggctcctactgacactacacacaaaaattaactcaaagtggatcatagacctaaatgtaaaaactaaaattgtaaaacccttagaagaaaacatagcagtaaattttcatgatcttgggttaagcactgatttcttagatgtgacaccaaaagcacaagcaataaaatagaacattgataagttggacttcaacaaaattaaacttgtttatgcttcaaaggacaccatcaagaaaatgaaatgataacccacagaatgggagaaaacatttgcaaatcatatgtactatgtacccgatgataagggacttgtatttagaatatataaggaacttttacaactcaataataaaaagaaatataactcaagcagtgagcaaaatatttaaatagacatttcttcaacaaagatacaagaatgtctaatatgcatatgaaaagttactcatgattagtcatgagacaaatgcaaatcaaaatcacaagatatcacttcgcaaaagtaaaaggctatgactttttaaaaaggacaataatgagtcttatcaaggatgtgagaaattagaaccctcatacattgttggtggggatgtaaaatgatgctatcactttggcaaacagtttggcagcacctcaaaatgtgaaacatagaattagcatatgacccagcaattccagcccgatgtatctacccacaatgcatatgtccccacaaaaacctgtgcatgaatgttcataacagcattgtttatggtagtcaaaagtgtaagtaatccaaatggacaaaccagatgtggtatctctatacaatggaatattattcagccataaaaaggaataaagtactgacacctactacaacatgaagaatcttgaaaacattatgctaagtggaaaaatccagacacaaaatggccatattgtgtatttcatttatatgaaataccaagaataggcaaatccaaagtcagaaagcagtgtggctgccagaagctgaaagaagtggggagtggggagggactacttaatagatgtgtggggtttcttttggggaaaatattctgaactagatagtggtgatggttgcgcaacattgtgaatacactaaaagctaccatattatatactctaaagtgattaaaagtatgaattttatgttgtgtgacttttacctcaataaaaaagaagacaaccaaaaaatctaaatgtgattcttaatgggacaagaagctctaaaaaaattaaattcttactattccattgcaaacaattccaataagtatgtgaaatatggagccatctgataaaacctatagcagtacgggaaggtatactaactcagcttttaactaaaaattatacaaatgttgactgacacaaaggcaaaggagaatagcaaagatggcatgagcctttaaggaaatcgttaaaaagtggaaaccttttaatgaatgcagttaaggcttaaagaaaatgtgaagtggaacataaaaagcgttttagaacagtttggagaaatgaagagggtggggtggggaggaaggttaatttacatatcgaggaaaacagaataattttggtagagaataaagaagaggtagggcacttcgacccctggtttcatcctctattcttcatcaaatacaataattttgggccgggcgcagtggctcatccctgtaatcctagcactttgagaggctgaggcaggcatatcacccgaggtcaggagttcgagaccagcctggccaacatggcaaaaaccccatctctactaaaaatacacaaattagctgggggtggcagtgggcacctgtaatcccagctactctggaggctgaggcaggagaattgcttgaacctgggaggcggaggttgcagtgagccaagatcatgccattgtactccagcctgggcaacaagagcaaaactccatctcaaaaaaaaaaaaaaaagaaaagaataattttcaaactggaaatgaagaaatgaaaaattatgacagataaaaagatactaagagagaacttagatgctttgaaaatgatcaattcttctgggtcttttaaactaatccccaacatacaaaaagaatttgcaggcatggttggcaaggcattgggagaattttttgaaaacctatcaggaatgaaggaaatccccaactcaggaacacagaaatagtggatcgatacccagcaaaattctagagcagattattaacagataatgtgtgggctcttagaaaataatgcagtgatcagtaccaagccagaatgagctcactaaagacatttttaaaacaagtcctaaattcaaaggacttccgtggacttcaaacgtgtcaaatatttgcaagatatttaataatttgtttttcactatatcaatgggaaaaatatatatatattatcatttgttgagtgttgtgtttatcacaggccctgttgtactacatatgtaataagaactaacatttatttatcaagggcttaatgtgcatgaagtgttgttctaaatgctttgcatacattaattcacttaatcttcactacaacctcatgaagtaggtgcaatccttattatagataaggaaactatctttaatacagaagaattaactaacttgcccaagaacacagagttagtaagggaagacctggcatacaaatacagtttgacaagcccaaagcctgcattcttaaattctatactttgttacctcccaatgttatctgtaatccccaccacaaaactataattttggtattgttacacccattttatgaataaggagactgaggattggagtattgaatagaaaaatccagtagaatctagtaagtagtaagactaaggctcaaacctaagttcatttggatctagactgtatcctctattcactttgtcattctgcgtaatgctagacttggtgaattctcagctgaaagaacggccatgtataaatatacaatttagaaaaatgtccctattgttacacctcatgattttatccttcactttgacctgttcacattgatcttatgtaaattcacacaaggtatgcccattaaatgtacaaatagcaaattttgagatcggtatatgatgatcatgtcctaatgatctccagctaatatgtttatttacagcataaattaaagattgaaaatcatctgaacaaactggaaagatagactgaaactgtcaaaatagaatttaatggagataactatatatttatacagtagttttataaaaatgagttgtaatgtctggaagaagggatcctgaatttttagtatttgttgtgtaacgcgctcatagtaattaaggaaaagattttctgaaaggatattagaaattctcataaaatcaatttgtgcaaaatacagctaggactcacagaaagaagaaaatcaccaattggctatgctttccgaatctacttttctctggatgtatgatctgttctcctcctgggaaaccagattccactgtaagcctgtcatattctactccacaataacttcagtttgaacatacccagctctgtttgctaagagatgagtctggtttgaatagcacagggctttaaagctctagttacactgtctaactgcggtttctgtacctctagttcaaattaatgagcgtagtatcttcccagatccaataagctattgccagaaaaaggaggttatttggtacaagcatgacctctatgtcatctctttagaaaggaatcccaaaagtggaaaaggactacatgctcaaaataattcaccaatgtgataaaacaactgaaactatcatagataacaataaaacaagtggaaaccagatgagtacagtaatactctgacagggcaacaatatttgaatcacatttgaagagacgtgaacaaactgtagcaagtctaaaaataagaaagataaaactaataaagtagtctgaaataataccatgtgcagaaagaaacaaggatgtcacataaagaaaccagagatatttataaggacacctttacaaaaaagaacagatctggccttgagttttcaaaagatataatgtgaaatgcagctactctacttgatctatcatagctggctgaagtctaacaatcaacaagcttctgttctcccacactaccctcacctttcttctaggactcctagtaggaggatgctaagtttggttctctatctgtattgtgggtgagaggggctgtttgtttgttttagagacagggtcttgctctgttgcccaggctagagtggagtaacatgatcatatctcactgtatcctcaaactcctgggctcaagtatttgacctgcataataaatgtctacgcctcatgccactaggtggcaatgtgggtgttatactgaaaagatcacagatggttcactttgcaagtaaaactgtaaatgttcttaagtgtgcatttctgctgcttctgatgggctgaaaatcccctttgatttctaaagtaaatgtagagacgttttaaaaataaaggactcctttgtccaagatatattccgaaatcctccaacagagacctgtgtgagcttctgctgcagtaataatggtgaagatccggcaatttttgttggctattttgtggcttcagctaagctgtaagttggggagtttcaggacatgagatatttttcaaaattctggggaggggagagaagggactccaagtggctaatctggaggccctcctgaaaatgtgtaaagaaatgtgtataaatattgcaataattgtaatattctgtatctgatgatgtctttgagaacaggtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagacacagtgctccccaggcacctggagcccgtacctaaactctaaagttgaggcatcatttcttactcctgtctttcagacttgtctgtctctatccttggtcagatgatgtaaaatgtttaagtttttaaaatataatattctccccttctagaccatctctcttctctacaacatcatcaccaattatgttaaccagacagtatgtgatttttatcttgaaagtaaaatatacagggtataaaaatcccgattctgctacttattaactggatgatcttgacaaagttacttaacttctctgtgcttcagttttccctcagctataaaaaggaaacagtgttagccatggtacgtaaccccaattgtggggattacatgaggtaatatacacaaagggcttgacacatttcctggcacgtagtgttacataaggggtatcaattattagtattagttttagatgtaccatgagtttgctaatattcactatggattaataccacagatcattggagaagtatgtggaatataaataataagcaccttataataattttagtttttagattctttcctaatgatgtccagcacttggcctttttaatagtgttaagaaaaacagggagtagctgtagaaaacgtaatagaaggatgactctatggtttggtttgtggtgtggaaatgaaagactggtaagagatgtttctgaggaagctcagctgcttctttggaaaaaaggacaggttctaagttttcatgtggagatctctaatggaaacttgcatttgtggaaattcatgaagcaaaatatcaaacccagtgtatctaaatcaacggttctgtatatcccccaaggattctttacattactattcccaatcccagtggaattcttatatcaaaacaagttttatgattataattgttcttattactcaacaacatcaatcacatatattaaattacagctacattcttttttaaaatcaaaggctttttaaatcaaaatactacctgcacatatctaaaaagccaatagtattataaaggtctgttccttccttagcccatcaagaaaacagaaataccatgctctacccccaccttccaattcaaatccattctagcaatttctaattaatatgtatatactcttgatttatcattattaagcattatctattgacttccttctatggcagcatgcaaatactctcactttctcaacatagttatatatatatcataagctggggttaaatagacagtcagtgcatatatgattatgaccacatgaatattgccactgtccaaccaaaatgacaactatgagtatatatcctttctggtacaacgtattttcttagttaataattacatttttttcatttattctatgtcaatgtgctattttttctaagttcttcaacacagtcttaaaaatatttattaataatttctctcaaatgcttcaagcaccttaatttcttttttttcccctcaagattccctttcctttgacctccattgtttctctgtgtgaactgattgctctataagcataaatgtgattctagacattttagtaccactctcccaagttggcattcttgcattttggatctcatatcttcatttcccaaagacaaatactagagagaaaaaagggagaggaagaagaaggagaaagagaaaggagaaagaaacactcttgggctcacttttgaacaatgagagaaacaaatgaataaatggttcctgccctcccccatgccctgcaggaggaaaagtctgcggcatattccaaaagactcttcagaaggtcatgccaggatcaggcaccagtcatgcacatggtggccagctccattatgcaccattgcattggctctctccactacccaaatttgctctcttgatccctcactcctgctccatgagatcagttcccaaaaatgccctgcatgcaaacctttatctcagtctcagcttttaagggaatgtaagctaagacatgccttttctccctgtgaatagagaggacacggagccagaagacacaaccctgcccgtctgctctcagtagtgcctcatccccttcaaaagccctagatactggcctatgcagctgtcccagggactactgaccacagcttctctatcggtgatacatgttcctggcttcctgtttttaagaagtactggacacacctgtgtcactttcctgaaagaaagagtgctgagattggagggtccaagtggaattacaggctgagacagagagaagatacaggagatgctggccctaacagagagggaaaacaaaacaaaacaaaacaagaaactattcttatgaaataaaataaaaagtctccccatctgagagtccactggtctttcctgaaagccaagtcatttttccatcgaataaatgcacgagtaaaaatcaagaaaacataaacatggataaaagtttcctcatagagttgacaagattattcacagagacagacttcttggtctcaattttctcagcatcctcagagtttactgtgtggacactatgatcacagaaagaatctcaggtgccaaagctagcaattcaagttgtttctggtggaagtcagtgccctcctgtagtcaaatgaatgaactagtagaaaccactgctttggtcagtttcccctctcctgtatctggccttcagcacctcagtagatgcttagagagcacttaccaggcaccagctcccagttgatatgggaaccattagaactctctccagagaaactcagtctggcccagtgtttctgacttcaagcctcatttccatgaatcaggtagctggtgaaattgatagactgcaaactccatgagggcaggaaccatgccttggtcattacagtgtccccagtacttagcatagtgcctggagccaggagcgttctcaatgatctacgctgctttgtcatctgctctgataatgagagtttcttgatgtcaagggctgtgttttgttcatttttgtatccacaaagggattagcactgtatttaacaatagtagaaactgaagaaaaaaaaattgtgtggaattacatttcctctttttcatcagaagtgacttagtcttgctgactttctttctatgcccttgtgtgttgcctctttgtttgcttacttgatttttttgcctcactgagaatgtaaggtctgtgaggacatcggcttgtgtttcttcatccctgatatttcttttgcaaccagcccaattctgatatctagaaggaggtcaagaagtggtttttggaagaataagtgaatgtaatagttatttcggacttgtgttaaaaggcctctttgcacgatttagcagaaaaagcactggagtcttagtcccggttttgcagctaactgggtaatgtaattctgaagtcacatccccactttcggcttcagtttataacctggaaaattaggataataatacacactctacctttatcaaaaaaaatcacgatctaatctgaattagatcatgaaaatgaataccttttaaaaagtgaaaaattttaaacaaacaaaaattaatattattaaggaattatatatatatatatggaattaaatggacaagaaatattatcctaatatactccaagacaatagttttcactcccatacttatccgcactgctatacaattcagtcagtgccaaatcactacccacacacctggttgtccttattactgtggctttgcaaccttcccatcactcagcttatctaaatattctcctgtatctaaaaccagtttttagaatctccaaagagcttgttttccaacatcccccagaaacatgcatttctcaccttactgagccaaactattccccagtgttcatcctctctccaagaaaagtttttattcatttggtcattggtcaacatttttctcagctgtctatttctcaaaatgtatgttctattctactattttcttaaactaatgctattttcaccactggccaaactttgtatttgaatttgaatcttatttgaattttacattctactttggccatatctttgtaatcagaaataccagtgatagtactcaccattcggtgtacaaagtatataaaatagacatgctccatatctattaagtgatgaaaattttctaggtgattttattataaaattaaacatttttagaagaaaatgcttctttagtagattgagaagaaaatattccagggaatgaccaacccagtgatgtcatcttactgtatatataaattttcatacttgattactactataatcaactacaatgtgaacatttcttttgaagtgctaatcggtatgaaatattctcttcaacctcagattaaatattcaccctcagtccccctcatttcccctgaaatacaatgacattaaattgcctgatctttgcattttctgatttattttatttttatttattttcctttgaggtgggctgggtacttgcaatggctaatagtgcagagctgcaattctaggcactatcagcaggtgttttaactaacacattatgtggattatttaaaaacttaatttaaggtatatgataatatagtactgctttgtatttttacaaactcatatttttttttttttttttttttttgagacggagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcccggcctacaagctcatattttaaagctccattcttagctcagagctgagccattaaagttcaataatgtaagacagcaagaatgctaaagcttgatgctaaacctattcagtaatatggaacagcatttgagatcaggaaggaggtggtcccacaactgggaattaaaatcaaaatggatttgagcagataaagctgcatgtccaaaggaagttggtgggaaaacttgaatctgccaggaattttctgctagatttactgcagatcctgccagattcaagccaagcatagaaaaataagcagaaaacctccttcatcactgcctgtgaaagaatgttgagtccaagagacgagtagagaaagacctctatagattaggacccattaatatacactgacttggcaaaccgagacctagaggcaagtacagaccacaggaccaccagatgatttactaccttggatcctactggtggcaaaagctgctcccagggtccacttccctgtacagaaaactacctcatagaaactgaaaattatatggcaatatacatcaaagagtccttgcactctgaccctgtaatttcacttctagaaatttcttctttcttaaaaaaacaatcaagtatgtacaaagattcattttttaaatgttggtgagagctttatttaaatgagtggagaaggaaaagaaaccccaatgtctcacaaaggagttgatttaaaaactgggggcacattggatataaccaataaaaatcattttatctaaacttctgcttccagccacgccgaaataacagggaccagatttaccattccacttgaaacaacagcaactgagaaggctgcagacaaatgacataaatcaacaatttccaaaacacggtatactaagcaataaatgaccatgatcctgagagatgggaaacaaatgaggcgagccctaacattgcaatagcttattgccttgagagagtttctaggccacagcacaaagaggggaaactgaggcagaacctggtaggctccctgaattgaggcaacagatctgagacagagaagactaaggcagctgaagttcataagacagaatacacgagaggagagaggggcacagagaggacctagagatctgccgagggtgccctcaagtattcagcagaatgctcatctgcgcacgcatgtggaatctacccgagggtgggtggcggcagcagggaataaccattcaaaaagattaaaggaaagaggacctcttcaagtatgtctagaatttagaaaagagtttattgcttagccatatatttcttaattctttaattaatatttcatacatttcattttctctggctctagtcacttatcactgtggtccattttcaaacaaagaatcatttcacatattgaggaaacaatatatgaatagcctgtctggcttagataaagagtaaaggcaagagaccaggtgcggtggctcacgtctgtaattctggtcctttaggaggcagaggtgggcagattacctgaggtcaaaagtttgagaccagcttgaccaacatgatgaaaccctgtctctactaaaactacaaagaagtagttgggtgtggtggcacatgcctgtaattgcagctattccagaggctgaggcaggagaatcacttgatcatgggaggcggaagttgcagtgagtggagatcacgtcactgcactccagcctgagcaacagaacaagacttcgtctcaaaaaaaaaagtaaagacaagaataagtatcacccatatggcatgaccaaagtttttggtaaacctagggttttttttctgttgtcagtaataaaattgcccttaaaaactagtttttatttctcattcctgaactcatttacatataatgtcgaagtatgataaattcaaactatgctgacacctgtacgaatgtggcttagtatgatataaagtctttatactttcaccaacttcaaacctcagtttctactgttataaagttcatttcactctctcttgtgaccatttaaatactttcacatatttcatcgcatttttcatcttctagggctgaggactcctaattcttaagaatatttctgttatccctataattactgtcgtgtctctccaggcattcttttttagtgaacagttgtcattaatcacttccagaaaggattcaaacaccatctctacatttatccttccaagtgctgtgactattgccttgcgaactacattttccaggctcccttgcagctaaggtgcagatctgtattcagccaagtatttgattgggagatgagccatatgaggaacaggttaggcaggggcatcccttttcttggtttaggggcagtggaggccatgtggtctgggttaggcagcaacagcatcttcttgattgggccaggagcagtaacttcctgtttgggcccatttggctgcatattctgttgctggcagcactggaggcagctggcatagggataggactgcagccttcttatgaggctgatggatgggtggttctgggcatcactcctggaagtcgagcctagaatctttttctccagtctgcccaatgattctatgagccttctgcctccccaaatcctgatctgcttacactaggtaaagcgatttcctttctttcttgtcccttagcacacagatatctcacagtgtttagtctgagacccaccacagctttcattccagcatcctttaagctgagtatcagacctggttcactttttcactgcagtacacttggctcattccaatgaggatgacttcatgtttatagtgatttctggttcctttgcttggaaatcctaaaagatagaaaagagtctccagttgctgcagacgcaggcatgagatataccgaaaactctccaaaattgtctcttggaatgtttcttcattacttcactaggtttctttctaaccttcagagctagtaaggaccttggattaaaagggccattgaatttctagtttagttaagaaatattttcctcatttcatgggagtggggaagcagtgcagactaaactcagagcccacatcatgttgttcttaccagttcaaatcaaatcacggtttccagtcacttggctaatatttatccttctttaaatcttgatgaaatgtctcttcctcaatgaacacttctctgcccctcaacctaaatttgttcccctcgtgttactgttttaaagaaccctgtaatttctatgtatttctgtgtgattatttgtataatatctgtccttcctattaacctctaagttccactaaatgctctgtgttcagaatagtgcctggcacaaaggagtatgacaaatagtgatgagtgaatgaatctgagccatcagacatgtatcttactttgtgttgggctgtccctcaagtgtagatgttcctagtgacaatcccattaattcaaacactgactggagaggattgaaaacatatgaagcagtgcttttggaactgaggctgtagtccaatatgactggagataaaaaatgaagactttaaaaacagaattcacataaaagcaggtatcaacatggaaaactgcagaggatgcctgtatacacagtgggcacagcagcagcattagaccaatcacctccaaacttgaggttccaggctgaggtgacagatcagagtgaaccaggcactgtagaacaatgggaacacttagattcctgacactggaatttgctgattcttctactaacgtgtagcaagaaatttagccttacccaaagtcaggtctggtctttgtcccagttcctgggagataacctctgaaggctcggaatttcctgaattgttggcatgtctttataattgatggtggggtccttggaccgcacttaatagtttctgctatcaagatgactcattgtgaggctggccacaatcaatggtctcaggatgggggctggccatgccagaaagaccaaccatataacatagggtggagggtttgtgtcacaacctagagagtgagttcaaccacacaggctatcagtcatctgatataatgaagccccaataaaaactctggacaccaaagctcagctgagttttccagactggcaatattccatgggtattgtcacgccttgatgctgggagggtaactcatccctgaggacagtggaagtttcacgtttggaaccctaccagactctgccctatgcatctcatcccttggctgcttttaatgtatcctttctctgtaataaacgaatcacaagtatactaggtttcaatgagttctatgagtctttctagtgaattatggaacctgatttaggaaatacccaaccttgccattggtgccagtagtgagagtggtcttgcatgaacttatctcccctttgtagttgagtcctagcgacttacagttgggggcagaagtcttatgtagatttagtctggaggtctatgaccttaaccttgcagtttggctaactctgggtagctacattttgtattgagcaactctatatgaataaaagaagttttgttcatataatgccttaacagtgaatcaagtatatcaagaaagttttttaaaagttaaaagtaggcaagtctactggtaataaagtaggcaagtcacaaggtaattaaatgcctacgtttcaatgattacacatgttgcttagaacatacacatatatgagatcatcacgttaaaatatttctaacacacaggctggcaacacctaacaataataataattagtaattgtctagttcttactactaactggtttctgttctgagtgttctacatatattaactaatttaattctcataagaactctggttattagccaggtttgtagaagctgaggcacaaggaggttaaatacttcgccctatggcacactcccaaaatttgaatccaaaccatccaactccatagctcatgctcttaaccaatgccccatacagcttctcagaaggcaatcacttgaaatttctctctgatcttatagaaaggtgttagtagactggttatcttaacgtccaatcccaatcatctttgtagcaaagtaatatttttatatgaacatgtcagaggcatttgaaccagagcaactccatcttgaataggggctgggtaaaatgaggctgaggcctactgggctgcattcccaggaggctaatgcattcttggtcacaggatgagaaaggaggttgacacaagatacaggtaataaagaccttgctgataaaacaggttgcagtaaagaagcctgctaaaatccaccaaaaccaagatggcgacaagagtgacctctggtcatccttattgctacactcccaccagtgccacgacagtttacaaataccatggcaatgtcaggaagttaccctatctaaaaaggggaggcatgaataatctaccccttgtttagcatataatcaagaaataaccataaaaatgggcaatcagcagccctcaaggatgctctgtctatggagtagccatacttttattcctctagtttcttaataaactttctttcactttactatatggactcaccctgaattctttcttgcgtgagatccaagaaccctctcttagggtctggattgggacccctttccagcaacaaagagatgtgtattttatttctgaaaatacttttttgctttgttatcattctcatgttaggccagcagctcaggaagtcctggtctccttcctatattggaaaagggagttcacaatgaacacaaaagaagaaaggataaatttgaaaattcctctggagacaatagaatggaaaaaaggggttttgagtttgggttacgacttttgagtttaaaaataaatctatgcctcaaaaagttctcttagaatatatctgaatacaaaaaccaattatgcaaccctagatttaatgcaaatttcttagtttctgggaatttctggggtgatggagacaaaagcaagaaagtaagacatcagtgaagatctctgcccatctccacataccctcccagcagtggggtgggaggaggcaatttttagcccccaaataggatgttaggaatctgaaactagaggagattgacaactaattcctctcagaaagactgagtgacagtatcctgcaaatttccaccagggcagagacagctgtgcagtagtgccaataggcccagaaagcccaagacagccccattctgccagactggaattagagtagttgaatttttgcatgcacacaaaaagcatagaaattaacagagagagacttagtggacctggatgggtgtcaatattataataaaaaggatgcagagcatatagattaacagccagagacctacagggactcagacatcaggacattagaaacaataatgtcccagactggaccctaagcactgcaccccaacagatgccagtatgggccaggtgtccccaaccaatgccagaccaccagttaaggcctctacattccaccccaaggatggcgaggaggaaatctgaactgatggaagacatcctgaattgacttagaaagtcatgattttactgagaaaaccctgtatttacttaaagcaagctttctgacaccacgcaaagtggttaccagagttagaaattaggctgttatagaaaataaagctatcctggattgaacatctgagtaaattacaaaacatttacccgctacatctctattcaccagatagcgaactcaagcattcctctgcccctacataaatgacaaatgacattcacgtgtattacatatcccctcaggcctaactagggctgtgtgctgtttccaagaccaaaatgtcacaactgtaaaccactcacctggatacttgctataagaaatagcttggattagtatggaacttggtgtaaccctcaaatatgggagtttgtcactagaggtaccagaggaccacattctctgttaggggacctcgatgacagtatattacaatgaaggcagtgactggcaaacagcagcttcaaataggcatgcaaacaaacattgagaaacagtaagcacataagataactcatttagacacttttatatgcagcatgtataggatttaaaataacattcccaagttgaactgaaaccattactatgtaaatgccacagccaagtcaaatgaaatagtaaataccagccttgcaaattggtctccctcaagggcactcaaaagagttagactgcgtgctgctgccttaggaaatgtcctcctctctatcaatcatttctgctttgacatcaaacccattgaccagcatatgttttggaatttctgaacaactgactttcaaggattcacattcattctgcactttcttagaaacctcacaggagccactgttgccaataaaataaaataaaaaaacacaaacattataaatctaaccccaaaatgggattgcttcaaaagagaatggacaccccactccctacattgcttgtacacatctgtgttgattctcttggtgaactggcccatgcaagcaggagctcatcaatcagcagttgtcaccaagtgcaagtcagaattgctcaacagaaaaattgagtctttttttattccctattgtcacctactaaaatgtaagttgcttgttgatctcatcacactgagctatgtttcagggaagtgttgaaaaggcccagcctgcgcatattcttgaaattttgaaataatggctcagtgaacagatgtatactttctcccaatggctctttgtggaaatgaattttttatgagcccaaagtatctttgattcatccctgattaaaagtcaggttaaaactaaataccatatactttttgaaagacattttaggaagttattgacacaaggacttttgagactgaaaatcatgggttaacaataaacctttgtttggtgaaacaaaagaacagtacaggacagaggtgaaaagcacaggctccagggccagagtccctgggctcagattcttcacatttcagctctgtaaccttgaacaaactactccagttaatcataacttcagtcttttttaaaaaatgggatattaaataatgggtattaaataatagggttgccatagaggaaaatataaggtaatatttatatgcacataaaacagtgcctggcacagagccagtgttcaattagtactagctattttttggatacatgtagataaaagaagcatttaatgaatagttacatgcccattaacataaaatgtaagccacttccatattctgtagcttatggtgacaaagttttctgctcacgtattaactaaaaggagcgaagagcttccctataatattgaaaattttatcctaatggttccaaaggactgttttctaggaatgtttgctacagaaacctcactggttagatgtttgttggagcacactgtgattattcattgtcactgcaaactgtgtttaccacgggaggctgttctgactcaccactttgtgactcaccgattagtaaacagctaaatgtcgcattgctgatttaggtgtaatttactgcgtcaatataaaaggactctgcagattctactaaaatcaagaacatagctaaaggcattcttcatcgtaaaaacgaattttagaaaacaagatgactctaacagagttactttaaaatacaatgcaatatgtctattttaaatgacaacaatatctcctgtctgacagcattcaacttactttcagatttattcggtgttttctcaacttcacgagaaattgaaaatccataaaggagggaaatatgtcttgtttcattttcaatagttatatcaagaatacttttcaaaagtatttcatatttaccatgttttcagcaagtaactcttaacaatactctgagagtatgatcgtgatgataggtaaaaatcaggatcactcccttttcatctttacctgtgtagagcaatgtaatgtgcccttttcccaaaccctctgactccatgagggatgagacacagagggtgtggctgagggctcctaggaccgggactccttggctgatgtcctgtggcctgcagtccagggcttgcaggtgatcaaacaggaaaggagaaatgagggaggcacagtgctacgagcaggcctgtgttttcactgggaatggtggttagcagatgctcagatgtgtctcttctccctcacactcacctttggcttggctcttaactcctgcccacccctccctaaaccctctgtggaggtccggaactgagcgagtcacagacacccagcaagcagtctccagagaggcctctgtgcatgaagacttccccagaaggatgcccactcttcctacctggcctgggaactcaaaatgggcacaaaaactgaagactgtgagagagggtcagcttacaggccagaaactgacaataagattgatgttcaaatagctgaattattgattcttatcctgagatccactcctcattttcagtcttgcgataaaccttagtgaggggtgttttgtcttgtgttctatctattggtggatggattccaacttttctgaatatggggacgtaatttttaaagccaaaaattttgcagatagtaatggatttttaacatccattgattaacaaagtactatgaaaacagtaacacttttaaataaatttgctttcagtttttttaactaaacataatacatgcatgtatatatttaaacttatcacactgcctggcacagtgaaagcactcaaaaaatattagctataattactcctattgctgttgtttactcaatcataggtaatgcctggtatacatgtggattcttagagtccttatagaacacagcagcacataaactatactaggctctaaatcttctctcccaagaacttcatctgatgcatatttcaccagcaacagcagcatttagcactgtcttgctgtagaaaaattcttgataaattaattgaattaaatttatgtcacataaaatgtcatgaagagatggaagtgtcttggtcctgtatcttagcattttcaaacctctccattgttttttttttaatgtatagatttcacctgtgtaaaaattaaaaataagaaaactgatcctaatgctcttcatgaaaggcaagaaaagccttcttggaaagcaatagttatgggagagttctgccagaatttgttctcagaatgacatgagaacaattttattctaggaaatagaggtgctgaggactcagcttctgacctaccctagatcataaacatcactgcactaacagccaattaagaataatctaagctcttgtccttttataacagacctggttatgtcctaaaaaataagagcatttataaataaagaagaaagtttaacagttcaatagatcaacgtgactttccagctcctctctgaacaggtgacatctatttccccatcccttgaatctcagttggccttgtaacttatgtggatcaatagaatgtggccgaagtgacagctgtgcaagttctgagccctcacctcaagagcctttgcactctgtcacctgctctctcagacctcggcttttttccacgtgaataaaccgaggctaaccttctggaagaaaagagaccatatgaaacagaaccacatcagcctgaggccctggacatgtgcgaaaactgaagatcagcaaagctgacctgaaattgagtcacagttgacctcagatgcatgagaatctaaccaaggctgaaaacatttggttgaatcccacctcaatttctgacccagagatagcaactaatgtacaatatcatgattgttatgcagtcattagaaagaatatattagataaatgtgtattggcctggaaaaggtatcatctaagtatgcttaatgattatccatcttaaaaaaaaaatacagaaatagggttgtagaacaagggtcctggtcatactgagcttacacttctgttgatgaaataaaacacatatgagatgatgaggaaataattcaaccaacaagaaaatactttacaaccaagagacttattaaataaaatgggtgcaccttttataataccaataagtataatagtaccctaacacagtagacacatttctgttgtctgtagttatctttcagaaagccgtcttgggagaacctttaaatgacctcagagagcgaaggtttatgtaaataaagaattaagtcagtgtgggtagaggttcagcaccagggtgcaggaagttatgtgaagattgtggtatggggctcatgtctagaaacagagagtggccccatgtcagcctatgagggaggagccaggccccacctcaagggtctccttcaggaagatctctgtgggaaaggagcaggggttccaggttttcagcaaagcctgtgcttgggcaatccatcaacacggttagtccagggcccacatataacctctgacccttctcacatttattttctctgtctggtacttcctctaaggagcatcctgccactcaccagcccctaccaaacacacacacacacacacacacacacacacacacacactcatactctatttgctcataatctcataatcatccatcaggttttaactgagatagtacttcttctgggaactttctctggtgagagatcctcttatgtggctcttgacctaccaaaccagaagcagttgtgcaattagtgatcattattctcttatttattatagtatctccagcacttagcacaatatctgcagacagtgggcacgcactgaaaaaaaaatactttttgaatcaatgaattaaatagctagttttcattcaccctaagaaaataccaaacattggtcttaagaatgtcacaggcctgaaggtataaaggaggaagcaaggaaacaaaatcaacagacagagccttggcaaaatctgctgttcaccagtcctcccagcaaatccatttcccattctggggaagcaatgccaaacagctccaggaactctgtacatggtctgtcaagtatccaagacagaagggagacttttcaagagtggaagcccagcctgcttgctccagtctggactgtgctggtctctattttcctagtcagggatggccccaacctgggactgtgtctcctctcaggctctgaggccttgggaatggaggaatgtcgtatctgccagtggtttaggtctgtattgtgaagaattaactttcccaaacagagatctggccttcaccctcagctgctgggtggtgattcctaggctcctggattgtcctgccagataggagtatctttgtttgcctgagggctttggccaccagtcagtctaataacgtgatatatgatggggctttggaacatgccatgtgaattctgacctctggaggaaccagagatcattagctagaacctccaggaggggctggaggttaaaggtcagccacgtgggcagcgtgtgataaagctccaggaaaaactctggacaccaaaggctcagttgagctcctatcttctgcaacactccatgagttctgtcacacaacatggctgggaggaggtaacacacccaggtctccctgggagaggacaaccagaagcttcatgtttagaaccctcccagatttcacccaatgcttctctccctttggttggttctgatttgtacccttttgctctaataaactatgatcatgatcactttcctgagttttgtgtgttgtttcatggaactatcaagcctgagggagcatgggaactcccagatttgtagccagctagccaggagtaaaggcagcctggggacccggaacttgtggctgatgtttgcattgagggcagtcctgtggaggactgtgcccttaacctgtgaagcatggccacctcccggcagttgctgtgagaactcattgcagggccactcagggaagtgtgggaaattgaaccaatgatgcctgacaccacggcttcctgactatcctctaggaagtctatcaggagatgcccctgttcacttccctgtaggttccagcgaggctcagagggtcatcagttctaccaacaatatctgcgcagaagagagtagctgtgattttattttagtctgaaagaacactgtttgttgttgattaacacctaaatattacaaacagtctctcagtgtgagaagatttatcttattctcctgtgtaattagaatgattattcaacaaatggatgttatctagcgaacttccagaaagaagccaaatttatcaacctcaccaactcacacatacagccagggatctatattcttgtgctctcagagaaggcatggagcttggactgacagcaaaagaccaacaaaacacccagaagccagtcaaaaatggcccaggctgcaggatccttgaaagacctgaaaacacacgaggaaaaggctgggaaatagtaatggtgagtggacctctgcggtctggagaggaaactactggttattttaggaaaaacattcccataatggggctcagggaaaaaagaaagtaatggtatccaggccttattctcagaagcattctcctccctgaatccagtatctgaggtaactgagcagcagataaaaatagcattttctcgaaacaaagcaaaacattaaaaaaaaaatagcctactgtctaagctttgtctcccagtggaactcaggaaccaagccagcttctccagctgtgcaccttggctgtgtgtctcagatggaacatttctgacttcattccctcctcctcccacgtcactcggtaaggagggtgggccaggacaagcagctcagacagctgttcctacagctggccttaccacaatcccccaggcctcacatacatgcacctctgggccctgcctgcctgcactaaaccatccggcccagtgcaacagaccattctttcaagctgtctctctcctactcacaaccatcccaggagtcctcttaaaactattttttcggagaacacattgtgctttgccacactgttccatttatctcttggtggccattccatttgcctcagcaactctctatcccattttttagtactacccctgaacgagaaggcaatcttgttcatcttgccaactctaaatccttatcgcaatcgtgttgctttagattgcattcatgtgtgaataggtgtggataggtgtttggcactgtgttagatgccaaagatacagtgctaaggaaaaaacatacctgacaacagattttattatattccaacgggaaagataggataaacagatacataaacaatgtatatgcagattaggatgagtatcatgaaagcaataaataagaggctgacgggttcaatttaagtggggtggccagaaaatgcttttccttcttctgagagaagtgagcgaggggcacagagaagtccgaattgttacactaatgaatatttctgagcttgaaaacacaaaacaaggggagatgaggttccactcaacagaggtatatacacatcaattacatgacccagaaaacctgattcagacacaccttgctgacactactccatagggaaggtcattttcacttgtccacatctaccacacctccattttcactctccctgagataagaggatgtgcatttacactgtgtctgcctagcgaaattgtaccccccgctgaataaagcacagttagttgagattcacgaacaccaagcctctctttataatgactttagagagctgtgctaactgaccagcactctggatacttatgagcagatgtctggtagcaatggaacctctcatgaccacccaggctctaaatgactgttcagctcagcagctcattatcaccttcctggagttagagctccaacataagaataaatatctccatctagtattatcactttttaaatcaaaatctatattcagcttgagagtataaatatcaaaatttcagggcattttttctaacttttcttgggagattttagtaaaattccagggcagattgctgaaagtacaatctgggaacagaaactaatatagtgtcacatcatatgaagttaacctctttttcttatgcaattctatcaaacttcaaggaaattctttggaaatctgggccccactacatttaaaacaaaataggtctatcatgaaatgcctaataaaggttgatcttacagtgtgatcgaggtgctatgcagatctgagacaggtggattattccagaatgagaaagaaacacaggatgaataagtcgcactaatggcaatagcaacttctgggaaacaccaatttctggcagctgttgctttcgtcaacactttctcagcaaaattgccacagccatttctgagagcttagaagcactgctaggaatctctaataggagtctgtttaatgggaattcctattgactacagccgcttttgcatataggagataatgttgagctaagggaatctttcaatgattcattcaaaacatgtttatccaccatgtgataaacattatagtcagtgccatagtataaacttgaataatgcataatccctgcccccagggaactcacatccttctcgacatgcctagcacaaacacacagaattataataaaagttgtcaagaagaagatatgggtggcgcattatgcaagcagagaaaaagggactgccttattcatttagaagctactggccctctctagagattgttggtcttccagtacatctaaatattcttcaatcgtaaaatgccatgaagctagaagtacaaaatgctgtattatcagttaagccccctatttttttcttttttttttttttttttgagacagagtctcattctgtcacccaggctggagtgcagtggcacgatctcacctcactgcaacctccacctcccaggttcaagcagttctcctgtcttagcctcccgagtagctaggtttacaggtgcatgccaccatacccagctaatttttgtatgattagtagagactgggtttcaccatgttggccaggctggtcttgaggtcttgaactcctgacctcaggtgatccgcccaccttggcctcccaaagtgctgggattatgggattacaggtgtgagccaccatgcccagccagttaagcctcttaaagaatgtcttgaattataacaaacacatgatgcctatcttcccccatatctttatactgacaaaattaggttcaaaatcaaggcatggtcaccagaaatcaggtcagagggatcaagaaaacatggacagtgaagtgatttcacttccatacaggtgataaatatttcctaaaatacaggtagatgtgtggcacaaaacctccagactctgagcatcaaagtccctcctaataccagaaaggaaggacccagcatttgtcatctcagtctcagacaaatacatactcagagggcctcaggaacatatgtaaactaaaaaaaaaaacatgagaaattgagcaggagcctgagtttgggcttccttgggtgggtactgtattaatttcccataacaaaatactatggaatagtacacagatgtttctttcctcacatttttggaggcaggaagtccatgattgaggtgtcagcaggcttggattctcctgaggcttctctccttggcttgtgaatggtcatcttctctctctctctcttcacttggtcttttctctgtgcacaggcatcctttgtatttctccctcttcttataaggacataaatcctactggattaggaccttacccttatgacctcatttaacctcagttaccactttaaaagccatatcttcaaatacagtcacattgggggctagggcttcagcatatgaattttaggaggacagaattcaatccataatagatggggacagggcaattctcttcctaggtaagccttcccttagggccatttacggggagataaacaaaccccaatttctactgagcaaaagctcagagaccctgaagtaactgcagttagtaaatgagaaagacagaatattttcaatatcttcaagtctaatacctagaagtgatagaggtttattcacattttctcccagtcattttcttattctgtgtttatacagcatttctgttaatgacaccattattttcagaaatcaaaatgaaatcttaatgttatcattgactctccccccttccttgccttcacttcaatcataattttccatgtctatgtaagtattcttttggctatttacatattcatcagaaacctatttcagctcttattaattttcatgaagatcactaatggaagccacctattgttcatgcttctagttcaggtgctcctaatatgggaactgtatagtttcagttgatctataacctttcaccccccaggttttgtggttgtttttatatacactttcacacatataagtggtaatgtgttcattgctattatcagttgttcaaagtgggtccctcacccacgaacaggttaaaagccagagctctcctctctcctactacacttgctccttgtaaaaaaaatttaatctttgtgattaacacaattgtttatattcttccccctactcaaatactcccagttacaaacattttaacttgtagtttaaaatcgttcctggtcagcaatcccttctgtagactcttccaaaaattaccatggttcttataatcaatctcacacccaaaagaggagattttagaaaggcatagacaccagaaggcagggatatatctgtctaccacagtccaccgtctggccaccaatgactcacattaccctcacttgcaaaaatacattcacatacatccccaaaggtctcaagaatcttatctcacagagcttcagctcaaagtcaaacttttatgctttaaatcatggctaagttcaaacacagctcctgggcataatatatgaagtacagctcctggggtataacttctctccttctgtcaacctgtaaaactaaagaggcaagtgatctgcccccagtacacccgtcatacaattttgaaacaggcataactggtaggcatgggataacagctatagacatattggttcaaagggaggaggggaaaaagataacaaagagtcgttggtccatagcagttctaaaatctagctgggcaaatgttgggagttcaatgattaggttttagagcctaagattaatctcggctattggggaaaccagcccccagtatttcaacgtaggttcttttctattttccctaagtgtcggccagtctgagaaataaagagaaagagaacaaaaaaaagaaattttacagctgggtctccggggttgacatcacatgttggcaggttccatgatgccccctgagcctcaaaaccagcacgtttttattatggatttcaaaaggaggggggggtgtatgaatagggtgtgtgtcacagagatcacatatgatcacatgcttcaagggcaataaaatagcacaaggcaaatgggcaggacaaggtcacaaggccagggcaaaattagaattacagatgaggttccctgtcccactgtgcacgtattgtcattgataaacatcttaacaggaaacggggttcaagagcagagaacaggtctgactagaatttcatcaggctggaatttcccaatcctaacaagcctaggggcgctgcaggagaccagggcttatttcataccttatctacaactgcataagacagacactcccagagcagccattttagaggcctccccctgggagtgcattcttttcccagggctgttccttgctgagaaaaagaattcagtgatatttctcttatttgcttttgcaagaagagaaatatgactctgttccacctggccccgcaggcagtcagactttatggttatcttccttgtttcctgaaaatcactgttatcctgttccttttctaggtgcccagatttcatatttttcaaacacacatgctctacaaacaagctgggcagataacacaatcattacaggatcctgaggcgacatacatcctcagtttatgaagatgatgggattaagagattaaagtaaagacaggcataggaaattgtaagagtattgattggggaagtgaaaaatgtccttgaaattgtcaccatttatgttcttctgccatggcttcagccggtccctccgtctggggtccctgacttcccacaacacttggctctaccctcttgcctcttagcaccaccctctatcatccttcttctttaatgtttgcagttgagtagttttatcagcctgcttcctgccagtagaaatgttggggtctgacagcctcctttcatttcattttgtagtctttctatccctttcagtccaagccagtagtgtttctgctgaaataattttctcaagatctttgtgcatctaccatagatttcaatgatgttctgaccatcagaaaaaaacacacccacagatcttttccagacagcatatatttttggctcctgctcggatggctgaggggctacagtttgattgagtggatctaaaaggcacattcttaatctccttaaggagtcctttgtgccattgaatattctcaccttttagtctttgaggtttttttaacttttattttgagttcaggagtacatgtgtaggtttgttataaaggtaaacttgtgtcatggggtttgttgttcagattttttcatcacccaggtattaagcctgggtgtacacattagttatttttcacgatcctctccctcctctcaccctccaccctcaagtaggctccagtgtctgttgttcccctctatgtccatgtgttctgtgttatcatttcgctcccacatataagtgagaaaatgctgtatttggttttctctttctgtgttaatttgctaaggataatgacctccagcttcatcaatgtccctgcaaagggcatgatctcattattttttatggctgtatagtatttcatggtttatatctatcacattttctttatccaatctgccattcctggccatttaggttgattccatgtctttgctattgtgaatagtgctgcaatgaacatatgcatacatgtgtctttatgatagaacgattattattcctttgggtatatacccagtaatgggattgctaagtcaaatggtagttctgtttttaggtctttgaggaacagccatgctgttgctcctaatggttgaactaacttacactcccaccaacagtgtaagtgttcctttttctccacaacctcaccagcacattattttttgactttttaacaatagccattctgactggtgtgagatggtagctcattgtggtttttatttgcatttctctaataatcaggaatgttgagctttttttcatatgcttggtggctgtatgtgtgtcttcttttgaaaagtgtctgttcgtgtcctttgcccactttttaatggatttttttcttgtaaatttgtttaagttccttatagatgctgcatattagacctttgtcagatgcatagtttgcaaatattttctcccattctgtaagttgtctttttagtctgctgatagtttcttttgctgtgcagaagttctttagtttaattagatcccatttgtcaaattttgcttttgttgcaattgcttttgatgtctttgccataaaatctttgcctattcctatgtacagagtggtattgcctaggttgtcttccagggttttttttataattttgggtctttaatccagcttgagttgattttttttgtacatgatgtaaggaaggagtccagtttcaatcatctgtatatggctagccagttatcccagcaccatttattgaatagagagtcttccccattgcttgtttttgccagctttgttgaagatcaggtagttgtagccttatttctgggctctctattctgtttcattggtctatgtgtctgtttctgtaccagtaccacgctgtttttgttagtgtagccctgcagtatactttgaagtcaggtagcatgatgcctccagctttgttctttttgcttaggattgccttggctatttgggctcttttttttttccatatcagttttaaaatagtttttctctaattctgtgaagagtgtcattggtagtttgataggaatagcattgaatctataaattgctttgggccgtatggccattttaacaatattgattcttcctgtccctgagcacgggatatttttccatttgtctgtgtcatctctcgtttctttgagcagtgttttgcagttctgcttggagagatctttcacctccctggttagttgcattcctaggtattttattctttttgtggccattgtgaatgggattgggttcctgatttggctctcagcttgactgttattgctgtatagaaatggcagtgatttttttatgttgattttgtatcctgagattttgctgaagttgtttatcagttgaaggagctttggggccaagtctatgggtttttctagatatagaatcatgtcgtctgcaaagaaggataatttgactttctctcttcctatttggatgcaatttaatactttctcttgcttgattgctctagcaatctctttggcctgaaagccccctgaggacaaatacatcagtcaactgtttctttgtttgttgtttgttgtttcttttaaattattctcattacttagcacagatcatgtacaccatgagtgtttaataatatcaatagaatatttgggagcaggaggttattttgcttagttttatgctttcactgttgttgtagaacagctgggctagaagacattattaaacataaatacaactggtaaaatatcccagcagaagaaatgctttaaaaatatctccaatcactgcaggagtgcagagaggcaacaactcctccagcttttgcacatcgaataattggtttagttcactccttccacatcacttggagcagcggggagggtggggaaagcttaatgaccaggaaagcctttcataaagtcatcatcaatgttctttataacctaatgtcacttcaatagtccatggttttcaaataaatgtcctacctgcccacagactgaaattttagccaaataaatccataaatttaaacatattgacaatcaaaatggtaaaaagaacttttatttttaacttgtaaaaatggttttagaggtcatcaggaagaataaatgagatacatagccaaaaaaaatttaaatacttgccacatcagatattagaatgtgttctaaagctacgctaattaaaataatgaggtaccaatacaggaataggtaggtagagcaatagaagcattaagtataaacttataagagactcaagttataagttacaagaatttgacatatgttaaagttagcatctcaagccagaacagcatgtcaataaattgttgaaagacacctggataaccatcaggaaaacaattaaattagatccctacctcaacaactaaattccaaaggaaaaagactcataacatttttaattaaaaagcactggaagaatatatagatgaccttttacataactttgaaaaaggagaattatgttataaaaatcacaacaaaggcagaaattataaaagataaaattgacagatttgactaaatacatctttaaacatgtgaatattaaaacgctgtaaaaaattaaaagacaaataaagtagaaattatctaaaatatatatcaaagcaaaaactgcatttctatatgccactggtatataaaaatacttccaaatcagtaaatacaaattgcacacaaatagaaaatgatagaagaagctaacaggcatttcacaaaagaagattataaatgactgataaacacattaaaatgtctattactacataattaaagtaattctgaaaccaataaagtacttttttctgcataattctagggatttatgcttaggaaagaatttgtaataaagatccacacacaaagatatctatcagaatgtagtatataacaccacaaatcataaatgagtcaggtatggtggctcatgcctgtaatcctagaactttgggaggccgaggtgggaggaccacttgcagacaggagcgcaagacctgcctgggcaacataatgagatgctgtctcaaaaattttttaaaaagaaacaatttaggggggcggttccaagatggccaaataggaacagctccagtctgcagctcccagcatgagcgatgcagaagacaggtgatttctgcatttccaactgaggtatcgggttcatctcactggggcttgtaggacactgggtgcaggacagtgggtgcagcctatcgagcatgagccaaagaagggcgaggcattgcctcacccaggaagtgcaaggggtcagggaattcccgttcctagccaagggaagatgtgacagatggcacctggaaaattgggtcactcccaccctaatactgcacttctccaatggtctcagcaaatggcaccccaggagattacatcccgcacctggctcagagggtcccacgcccacggagccttgctcattgctagcacagcagtctgagatcaaactgcaaggctgcagtgaggctgggggaggggtgcctgccattgctgaggcttgagtaggtaaacaaagcagccaggaagcttgatctgggtggagcccaccccagctcaaggaggcctgcctgcctctgtagactccaccttggggggcagggcatagcaaaacaaaaggcagcagaaacctctgcagacttaaatgtccctgtctgacagctttgaagaggatagtggttctcccagcaaggagtttcagatccgagaatggacagactgcctcctcaagtgggtccctgacccccgagtagcctaactgggaggcatccaccagtaggggcagactgacacctcacatggccgggtacccctctgagatgaagcttccagaggaacaagcagcagcaacatttgctgttcagcaatattcactgttctgcagcctccgctgcagatacccaggaaaacagagtatggaatggacctccagcaaagtccaacagacctgcagctgaggatcctcacgttagaaggaaaactaacaaacagaaaggacgtccacaccaaaaccccatctgtacatcaccatcatcaaagaccaaaggtagataaaaccacaaagatggggaaaaaacagagtagaaaagctgaaaattctaaaaattggagggcctctccccctccaaaggaatgcagctccttgccagcaacagagcaaagctggatggagaatgactttgacgagttgagagaagaaggtttcagatgatcaaacttctctgagctaaaggaggaagtgtgaacccattgtaaagaagctaaaaaccttgaaaaaagattagatgaatggctaactagaataaccagtgtagagaagtccttaaatgacctgatggaactgaaaaccatagcacgagaactacgtgacaaatgcactagcttcagtagccaatttgatcaagtggaagaaagggtatcagtgattgaagatcatgaagtgaagcaagaagagaagtttagagaaaaaagagtaaaaagaaatgaacaaagcctccaagaaatatgggactatgtgaaaagacaaaatctacgtctgattggtgtacgtgaaagtgacagggagaatggaaccaagttggaaaacactctgcaggatactatccaggagaacttccccaacctagcaaggcaggccaacattcaaattcaggaaatacagagaatgccacagagatactcctcaagaagagcaactccaagacacataattgtcagattcaccaaattgaaatgaaggaaaaaatattaagggcagccagagagaaacgtcaggttacccacaaagggaagcccatcagactaacagcagatctctcagcagcaactctacaagccagaagagagtgggggccaatattcaacattcttaaagaaaggaattttcaacccagaatttcatatccagacaaaccaagcttcacaagtgaaggagaaataaaatcctttacagacaagcaaatgctgagagattttgtcaccactagtcctgccctacaagagctcctgaaggaagcactaaacatggaaaggaacaaccagtaccagccactacaaaaacatgccaaatcgtaaagaccatagatgctaggaagaaactgcatcaactaatgagcaaaataaccagctaagaacataatgacaggatcaaattcacacaatattaaccttaaatgtaaatggactaaatgctcaaattaaaagacacagactgtattcaggagacccatgtcacgtgcagagacacacataggctcaaaataaaggaatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcagccagattcataaagcaagtccttagagacctacaaagagacttggattcccacccaataataatgggagactttaacaccccactgtcaacattagactgatcaatgagacagaaagttaacaaggatatccaggaattgaactcagctctgcaccaagtggacctaatagacatctacagaactctccaccccaaatcaacagaatatacattcttctcagcaacacattgcacttattccaaaattgaccacatagttggaagtaaagcactcctcagcaaatgtaaaagaacagaaattatagcaaactgtctcttagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacatgccagaatctttgggacacacttaaagcagtgtaaagcagtgtgtagagggaaatttatagcaataaatgtccacaagaaaaagcagaaagatctaaaattgacaccctaacatcacaattgaaataactagagaagcaagagcaaacacattcaaaagctagcagaaggcaagaaataactaagatcagagcaaaactgaaggagatagagacacaaaaaacccttcaaaaaatcaatgaatccaggagctggttttttgaaaagatcaacaaaattgatagactgctagcaagactaataaagaaaaaaagagagaagaatcaaatagatgcaataaaaaatgataaagaggataccaccaccaatcccacagaaatacaaactaccgtcagagaatactataaacacctctacacaaataaactagaaaatctagaagaaattgataaattccttgacacatacaccctcccaagactaaaccaggaagaagttgaatccctgaatagaccaataacaggctctgaaattgaggcaataattaatagcctaccaaccaaaaaaagtccaggaccagatggattcacagccaaattctaccagaggcacaaggaggaactggtaccattccttctgaaactattccaataaatagaaaaagaaggaatcctccctaactcattttatgaggccagcgtcatcctgataccaaagcctgacagagacacaacaaaaaaagagaattttagaccaatatccctgatgaacatcgatgcaaaaatcctcaataaaatactggcaaaccgaatccagcagcacatcaaaagcttatccaccatgatcaagtgggcttcatccctgggatgcaaggctggttcaacatacacaaatcaataaatgtaatccagcatataaacagaaccaaagacaaaaaccacatgatttttgtctcaatagatgcagaaaaggcccttgacaaaattcaacagcgcttcatgctaaaaactctcagtaaattaggtattgatgggacatatctcaaaataataagagctatttatgacaaacccacagccagtatcatactgaatgggcaaaaactggaagcattccctttgaacactggcacaagacagggatgccctctctcaccactcctattcaacacagtgttggaagttctggccagggcaatcaggcaggagaaagaaataaagcgtattcaattagaacaagaggaagtcaaattgtccctgtttgcagacgacatgattgtatatctagaaaaccccattgtctcagcccaaaatctccttaagctcataagcaacttcagcaaagtctcaggatacaaaatcaatgtgcaaaaatcacaaacattcttatacaccaataacagacaaacagagagccaaatcatgagtggactcccattcacaattgcttcaaagagaataaaatacctaggaatccaacttacaagggatgtgaaggacctctgcaaggacaactacaaaccactgctcaatgaaataaaagaggacacaaacaaatggaagaacattccgtgctcatggataggaagaatcaatattgtgaaaatggccatactgcccaaggtaatttatagatataatgccattcacatcaagctaccaatgactttcttcacagaattggaaaaaactactttaaagttcatatggaaccaaaaaagagcccacattgccaagacaatcctaagccaaaagaacaaagctggaggcatcacgctacctgacttgaaactatactacaaggctacagtaaccaaaacagcatggtactggtactaaaacagagatatagaccaataacagaacagagccctcagaaataataccacatatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatattagatctaaaactataaaaaccctagaagaaaacctaggcaataccattcagggcataggcatgggcaaggacttcatgtctaaaatgccaaaagcaatggcaacaaaaggcaaaattgacaaatgggatctaattaaactaaagagcttctgcacagcaaaagaaactaccatcagagtgaacaggcaacctacagaatgggagaaaatttttgcaatctactcatctgacaaggtctaatatccagaatctacaatgaactcaaacaaatttacaagaaaaaagaaaaaacaaccccatcaaaaagtgggcaaaggatatgaacagacatttctcaaaagaagacatttatgcagccaatagacacatgaaagaatgctcatcatcactggccatctgagaaatgcaaatcaaaaccacaatgagataccatctcacaccaattagaatggcgatcattaaaaagtcaggaaaaaacaggtgctggagaggatgtgcactgttggcgggactgtaaactgattcaaccattggggaagacagtgtggcgattcctcaaggatctagaactagaaataccatttgactcagtcatcccattactgggtatatacccaaagcattataaatcatgatgctataaagacacatgcacatgtatgtttattgtggcactattcacaatagcaaaggtttggaaccaacccaaatgtccatcaatgatagactggattaagaaaatgtggcacatatacaccatggaatactatgcagccataaaaaacgatgagttcgtgtgctttttagggacatggatgaagctggaaaccatcattctcagcaaactatcgcagggacaaaaaaccaaagaccgcatgttctcactcataggtgggaattgaacaatgagaacacttggacacaggaaggggaaggggaacatcacacactgtggcctgttgtggggtggggggaggggagagggatagcattaggagatatacctaatgtaaatgatgagttaatgggtgcagcacaccaacatggcacatgtattcatatgtaacaaacctgcacattgtgcacatgtaccctagaacttaaagtataaaaaaaaatgaaggaaggaaaacaaaaaacgcaaataaataaataaataaataaacagtttaggccgggcacagttgctcacacctgtaatcccagcactctgggaggccgaggtggccagatctcctgaggtcaagagttggagaccagcctggacaacatggcgaaacgctgtctctactaaaaaatacaaaaattagctgggcatggtgtcatgtgcctgtaatcccagctattcaggaggctgaggctggagaatcacttgaactctggaggtagaggttgcagtgagctgagatcatgccactgcactccagcttgggtgacagagcaggaatccatctcaaaaaataaaaatagaaaaataaaaataaaataaaaattaaaaataaacagtttaaacgtccaacactagtgacttggtaaaataaaatttagtacatccacataatgtaatgctattgtcaaatgaagttatttatggatatttgttgacatgaagaaatgtttgtgaatcataatatattagtcagttgaaagaaagttgctgacattataaactgatgtttggctaaattataagtacagatgcacgcatatagtactatgggtatataacagggttagtatatatatatgtatatatgtgtatgtgtgtgtgtatatatatatatagtgtgtgtgtatatgtatatatatagtgtatatatatacacacatatatgtgtgtatatatagtgtatatatatagtgtatatatgtgtatatagtgtatatatatacacacatatgtgtatatatatgtgtatatatatacacatatatgagtgtgtgtgtgtgtgtgtgtgtgtgtatttatatatatgctttcttgctctgccagctgaaaagcaataacaccccagtagcaacaagcatggctaggtaccagaactcgctttgtaatcccattttccaagaaaataaatcagagctctctggagaaatgtctgattctagggctgggacaaggaatatacaagataggtctggagaaagttacagtgccagaaagtaagcaagtgctcaaaaacaaagaaaaaaactcacaatgatgggagtatgtaaaaaggaggtaagagccaattggaaacgttccgtttggctaaagccagaacaattggagcaataaaataaagtagtactgagtaataatccaaggtgtaaaacaaatatcgtgtgtcaatactgatataaataaatgattgaataaataaatggggagaatagacaaatctcccatgcagaagaattccaaataatttacttggagcataaagtgatagaatgtaactccctcctcaagtgtgggccatacacagtgatgtccttccaaagagcacagtatggaaaggggtaagaaagagcaactttacagtggtaaaatctgacaaacatggcctcagtcaagtgatcaaggttgacgtcaacagtagtaagtcacgttgacagtatgaaccttgatatggtgtgaggagaaatggcatgctacctatggcgtcttcttcccaaaaatgtataacctcagtgtaatcatgaggacatcatcagacaaatcccaattgagggaaattctacaaaatactgaaagggagctctttaaactgttaaggtcatcaaaaacaaggaaactctgagaaattgttacaaccaaaaggagtctaaaaagacaggattaaatgtaatgtggtatcctggctagaattctggaacaaaaaaaaaattaggtaaaattgaagtaaatctaataaagtatgaactttagttaataacaatgtatcgatattggtccattaactatggcatgtgctgctgtaagaagttaataagaagccacactggatagggatttatgagaactctgtgtactctcttcacaacctgcccacaaatccaaactattccaaaattaaatttcttcttttaaaactaagtttcatatgacttgatttttgttaagggaggattacaattttatgtatagctgtgtcattatagatatagctatagacatggatatagatatatagatatatagaaatatagaaaagcatttagctgtgctgtctaatacacagccattacctagatatagctattgaacacttggattgtggctaatccaaattgagaagtgctgtaagtgtgaaatgtacaacagatttcaaagatgtaatatgaagaaaagaatataaacaatatcattaatgttgtgttttgagacagggtctcattcttttgtccaggctgaagtgaagtagtgcgatcacagatcactacagcctcgacctcccaggctcaagcaatcctcccacctcagtctcccaagtagatggaactaaaagtgtgcactgccacacctaatttttccatttttatttattttttatttctaggtttactcaaaaacattattactcaattcataaaatagtaattcagttagctggtgcctaaagactgaaaaaattgtaattttccaggcatttacagtttggggaacaaaaaacatgagacctacttgaaaaaatagaggctaataaataattaaggataaggctctaaaaaataacagtattgcaagctatttttaaagagaaaaatttgatagcaaaatgtttctctgactttgtaaatgcacaagaaagatcaacagttttatcacttgcagaaaaggcaattaatgtaatagaaaatgtgatgataaacttctaagaaactaagtgcttatgtctatttaacaatagaagttttacctattaccatttactattcatgtgtcgacagcaatccccttctctcccaactaggcctttcacaattatggaatatagacataaaatattattcctagatacattttacaaaataaaaatgagtaaatggaaaaaaggcaagttaaagtagttatatatatatattgaaaagtgggtgaataaactgaattactttcactaaaatgactatacaatagttaatgtatttcttatttatacaaggggaaaactggatataatatatctttaacattacacagtcatagaaaaatgttaactttaacctgataaaatcctttccccacatgttttacactttggattttctttcaatgtttattttggatccagagggtacatgttcatgtttgttacatggatgtattgcatggtgctgaggattggggtatggataatcccatcacccaggtagtgagcatagtacccaatgagtaaattgttaccccatgacccaccccaccctctaggagtccccaatgtctattattcccatctttttatccatatgtactcagtgtgtagctctcacttgtaggtgagaacatgtggtatttggttttccattcctgcatatattcacttaggatgataacctccagctgcatccatgttactgattttgttctttttaatggatgtgtagtattccatggtgtatatgtaccacttttttctatccagtgtaccattgatgggcccctaggttgattccatgtcttagctattgtgaacagtgctgcaataagcatatgagtacatgtctctttttggtataatggtttcttttccttggggcatgtacctaggaatgggactgctgggtggaatggtagttctgttacaaattatccaagcagagatctccagactgctttccacagtggctgaactaacttgcattcccaccaacagtgtataaacataccattttctatgtagccttaccagcagttgttatttcttgactttttaataatagccattctgactggtgtgagatggtatctcattgtggttttgatttgtgtttctcttatgattagcaatgatgagcattttttcacatgtttgttgactgcttgtatgtcttcttctaagaggtgtctgttcatgtcttttgcccatttcttaattggattgtttgggtttttcttgctgatttgtttaagttatttttcctattcagatgacttttatttctttctctagcctgattgctctggctaagacattcagtactgaatgttgaataggagtggcaagagtaggcacccttatcttgttccagttctcaaggggaatggttccagcttttaaacattgagtatattgctggctataagtttgtcatagatggctcttgttattttgaagtatgtaccttcaacgcttagttttttgaggatttttatcatgaagcaatgttggattttatcaaaagcttcttctgcatcaactgagatgacatatggttcttgtttttaattatgtttatgtggtgaatcacatttattatttatatatgttgaatgttgaaccaaccttgcagcccatcaataaagcctacttgatcatagcgaattaacttttttatgtcacgctggcttcggtttgctattaacagtattttttttttagatggagtctcactctgttggccaggctggagtgcagtgttgcaatctcagctcactacaacctcagcctcctgggttcaagagattctcctgcctcatggagtacagtggtgcaatctcagctcactacaacctctgcctcctgggttcaagcaattctcccacctcagcctcctgggtagctgggattacaggtgcacaccaccctgcatggctaacttttgtatttttaatagagacagggtttcaccatgttggccaggctagtctcgaacatctgacctcatatgatccacccatctcagcctcccaaagtgctgagattacaggtgtgagccacctcacccagccagcagtttgctagtattttgttcaggatttttgtgtctattttcatcagggatattggcccgaagttttctttttttgttatgtctctgccagattttgttatcaaattaatgctaccttcatagaatgagttaaggagaagcccttcctccttggttttttggaataacttcagtgggattggtaccagttctttatatatctggtagaattcaggggtgaatccatctaatcaagggctttttttgttggtggtggtggtttttttttattactaattcaattttggtacttgttattggtctattcaggctttcactttcttcctggttcaatcttgggagtttgtgtgtttccaggaatttatcgatttcctctaaattttctaatttgtgggcatagaggtgtttgtaatagtctctaaagatcttttgtatttctgtgggatgagctgtaatgtcatctttgtcatttctgattgcacttatttggatcttcacccttttacaaatttcttaatctacctagaagtctatcaatctttgtttattctttcagaaaatcaactctcagtttcattgttcttttgtatagattgtatgtctcaatttccttatgttcttctcagattttagttatttctattcttctgctagctttactgttggtttgttcttatttttccagttcctctaggtgcaatgttagattgtaaatttgggatatttctagcttcttgatgaagacgtttagcactagaaactttcctcttaacactgctttagccgcatcccaaagattttggtaagttgtatctcttattttcactaatttcaaagattttttaaatttctgtcttaatttcatttttcacccaagagttattcaggaaaaagttgtttgattttcatgtttatgtgtagttttaagagatcttcttggtattgatttctatttttattgcattgcaatctaagagtgtgctcggtatgattttgatttttttaaatttattgagactcgctttgcaaccaagcatgtggttgatcttagaatatgtacctgtgtggatgagaagaatgtctattctgtggttgttaggtggagcattctatagatgtctactaggtccaattggtttagtgtcacgtttaaatccagaatttctttatcagttttctgccttgatgatctgtctagtggtgtcagtaaggtgttaaaataccccactattagggtgtagctgtctacaccttgatcttttcatagatcaagaagaacttgttttatgaatttgggtgctccaatgatgagtgcttatatatatttaagatagctaagtattcttgtttaattgaaccttttatcattatgtaatacccttctttatctttcctgaatgtttttggtttaaactctgttttatctgatataagaatagtgactcctgctcttttctgttctccatttgtgtggtacattttttcccatccctttactttgagcatgtgagtgtagttacacgtgagcttggtctcttgaagacatcagaaaattgggtcttgagtttttatctagcttgtcactctgtgtctattaagtggggcacttagaccattttacatactgaattagtattgatatgtgggattttaatcctgtcattgggttgataattggttgttttataaacttgattgtgtaattcctttatattgtctgtgagctatgtgcttagtatgtttttgtcataacaggtattaatctctcatttccatgtttagcattcccttaaggacttctcataaggttggtctggtggtaacaaattcccttagagtttccttctgtgttaaggattttacttcttcttcacttatgaagcttagtttggtgagatatgaaattcttggttggaatttatttgctttgaggatgctgaaaataggtctccaatttcttttggcttgtaaactttctgctgaaaagtctgctgatagtgttgtgggattccagttataagtgacctgacctttctctctagttgtctataatattttttcttttgcattgaccttggtgaatctgatgactatgtgccttggggatgatcatcttgtatagtattttgctgggttctctgtgtttcttgaatttgtatgtcaatctctctaacaagattggggaaattttcatagattatgtcctcaaatatgttttccaagttgcttactctctctctttctctctcaagaatgccaataaattgtagacttgatctctttacacaatcccatatctctcagaggttttgttctttttttaacattcttttttctttatttttttctgactgagttgatttaaagaacaagtcttcaaactctgagattctctactcagtttggtctattctgctgttaatgcttctgattgtatgtggaaactcttgtagtaaatttttcaattccaggagttcagtttagttctttcttaaaatggctattttgtctttcagctcttagatcattttaccggattctttggatttcttggattgcatttcaactttttcctggatctcagtgagcttctcaccatccaggttctaaattctatacctatcacttcagtcatttcagtctggttaagaaccattgctgggggctactgtgctcatttggaggtaaggagacatcctggctttttgaattgccagagttcttatgctgattctttctcatctgagagggctagtgtttctttaagttgagtatagtcagttggcttcatttctgggtgctttcagagggccaaggctctgtacaggatctttatttgtagctgaattcttgtcttaggtttcacaggcactgtacattggcaaaatattttggcagttgtaatttggactgtgatgcagtagatggtgtttaagagtgatgaccaacagataggctcttattcagccatgcagctcttttgtatttcaccatgttctcaatagtgctctgtggtggggtaaggcagagagataactccctcaccaggttcactcctgggccttggaggagccccctccaatcactggggtcatgcccaagtttcctttgttaggtgttctgggctgtggggctccctcagatagaggtcatggctggcagacaggccacttccttcccagaccagccctgtggagagaggcaccccactttcatgctggtccatgaaccagggcatctcaaccctctcagtgttttgagagtgagaacatttcccccactcaggcaccaccaagccagtgagtcttgcctatctaagtacagaaggaccatggaggtcgcatggtcagccatcagggtctccattttttgtggggacagaatcttactatggtgctcaggctgactgtatgttgaaatgacaatattttaggtatattgggttaagtgaaaataattttatatatttatttatgatttcctttaatgtagtcactaaacattgttaaattatatatgtggttcatattgtatttctactgatagcagttgtttaaaaggatagacatgagaatgttaacaatagctattcctagtagtaaagtgtaatttttagcttttcttttttctaatttttcttgaataaatatgtgttccttgtgtaattttaaaagtaataaaggtaaaaatacacaatgaactactgctgtgaaatataccactaacagaagtactaagcagaaatgtcaagtcttagagtcctaattatttattcatttaaatacatatatattaagtgtctcatgtgcaaggcatttggacagttgctaggaaaataaacacaaaaaaagatgagctataattattttcttcaaggggttcacagtccattttggaagttaggctcatgaatagaatattagagtacaatgcggtcagtgatactatggtgatttgtattaactctcctccccttctgctttaaatgttgctgtttttctggctctaaccttagtctacttctctgcccacaacacaattgcaactaacacctatatactaatggctatggctttaactttgactttgcttcagatctctacatccaactgtcttttggtcagatggccattgggcaacctaaactgtatgcctaaaacccatcatctcttcacctcccctgctccagactcttctacctccgtaattcttgtctttgttaatgatgccaccatttaaccagttgcctcatgactctgtaaaaaggaaatttagttactttacttcacttctcaaaattcttcaggcttggcagtgcacaagcctacatatgcccttagctaccaatccaacttcatctcctggaacacttctcatcagcattgacactctagaaataccaaactaccaaactcaggaaacatcacaagttatcacttctcttcctttcattgttgcgtgtgtccttccctctgcttgaagtgtccaacctcatcaccacctcttcttcatggttcctagacattcctctctgatacctcccttgatcttccaggcaaattaggctctcttctctctggctccccttgaactttgtacatacctccaacatagtgattttcccattatattataataccagctttctgtatgatactctattccctaaggacagagattgtatctcattaaccttggtatcctcagcgtcacacggaatgtgacagacagaaaactttcaagtttactgaatatttcctatctttctttaccttttccactctattgtggtcactcttaccctagaataatgtagatgttccttgaataccaaccaggcttcacttctgggtctttgttcttgaatggccttaccccagatggttccctctgataaaccaattagtcactgctcagaagtcacctcatcagagaggtttttccttcaatcctgtataatatagtgcctggcaagaaaaggatgccctctctcaccactcctattcaacatagtattggaagttctcaatcaggcaagagaaagaataaagggtattcaaacaggaaaagagtaagtcaaattgtctctgtttgcagatgacatgattgtatatttagaaaaccccatcgtctcagcccaaaatctccttaagctgataagcaacttcagcaaagactcaggatagaaaatcaatgtgcaaaaatcacaagaattcctatacaccaattatagacaaacagagagccaaatcatgagtgaactcccattcacaattgctacaaagagaataaaatacctaggaatacaacttacaagggatgtgaaggacctcttcaaggagaactacaaaccactgctcaaggaaataagagaggacacaaacaaatggaaaaacattccatgctcatggataggaagaatcaatatcataaaaatgaccatactgcccaaagtaatttatagattcaatgctattcccatcaagctaccattgactttcttcacagaattagaaaaaactactttaaatttcatatagaaccaaaacagagcccatatagccaagacaatcctaagcaaaaaaaaaaaaaaaaaaaaaagaaacaaagctggaggcatcacactacctgacttcaaactacactacaagcccacagttaccaaaacagcatggtactggtacaaaaacagatatagagaccaatggaacagaacggaggcctcagaaataacaccacacatctgcaaacatctttgacaaacctgacaagaacaagcaatggggaaaggattccctatttaataaatggtgttgggaaaactggctagccatatgtagaaagctgaaactggaccccttccttacaacttatacaaaaattaactcaagatggattaaagacttaaatgtaagacctaaaaccataaaaccctagaagaaaacctaggcaataccattcaggacataggcatgggcaaagacttcatgactaaaacaccaaaagcaagggcaacagaagccaaaattgacaaatgggatctaactaagctaaagagcttctgcacagcaaaagaaactatcatcagagtgaacaggcaacctacagaatgggagaaagtttttgcaatctatccatctgacaaagggctaatatccagaatctacaaagaacttaaacaaatttacaagaaaaaaacaaccccatcaaaaagtggacgaaggatataaacagacacttttcaaaataagacatttatgcagccaacaaacatgaaaaaaagctcatcatcactggtcattagagaaatgcaaatcagccagagtgagataccatctcccacaagttagaatggtgatcattaaaaagtcaggaaacaacagatgctggagaggatgtggagaaacaggaatgcttttacactgttggtaggagtgtaaattagttcaaccattgtggaagacagtgtggcaactcctcaaggatctagaactagaagtaccatttgacccagcaatcccattactgggtatacacccaaaggattatgaatcattctactataaagacacatgaacacatatgtgtattgtggcactattcacaatagcaaagatttggaaccaacccaaatgtccatccatgatagactggataaagaaaatttgcacatatacacgatggaatactgcgcagctataaaaaaggatgagctcatgtcctttgcagggacatgaatgaagctggaaaccatcattctcagcaaattatcacaagaacagaaaaccaaatactacatgttctcactcataagtgggagttgaacaaggagaacacatggacacagggagcggaacatcacacaccggggcctgtctgggggtcagtggactaggggagggatggcattaggagaaatacctaatgtaggtgacgggttgatgggtgcagcaaacaatcatggcacgtgtatacctatgtaacaaaactgcacgttctgcacacgtaccccagaacttaaagtatatatatatatatatatatatatatatatagtgtgtgtgtgtgtgtgtgtgtgtatttaaaaaaagatactttcctaattaaagatagtttcctaccttgaaaaatctctaatgccagctactaaagtaacaatttctcacttatccacaggggttatttctggccagtgagatgatgaatgactgttttatgttaatttttaattttatagtattctcatgggattaaaataattccgctaaccacaaaaaaaaaaaaaatcaggaaacaacagatgctggagagaatgtggagaaacaggaacagttttacactgttggtgggagtgtaaattagttcaaccattgtggaagacggtgtggcaattcttcaaggatctagaaccagaaataccatttgacccagtaatcccattattgggtagatatccaaaggattataaatcattgtactataaagacacatgcacgcgtaagtttattacagcactattcacaatagcaaagacttggaaccaactcaaatgcccatcagtgatagactggataaagataatgtgccatatatacatcatggaatactatgcagccataaaaaggaatgagttaatgtcctttgcagggacatggatgaagctggaaaccatcattctcagcaaactaacacaagaacagaaaaccaaacaccacatgttctcactcataagtgagagttgaacaatgagaatatattggcacacggagggaatatcacacaccagggcctgtcggggggttgggggctggggagggatagcattaggagaaatacctaatgtagacaaggggttgatgggtgcagcaaaccaccgtggcacacctatacctatgtaacaaacctgcatgttctgcacatgtatccaataacaaagtataatataaaaataaattaaaatttatattttatatatattgaaattatttatatattttgaaatatattatatatatttatatataaatatatattatatatatatatataaatatatattatatatatttatatataatatatataatatatatttatatataaatatatattatatatatttatatataaaatatatattttatatattccaccagaatataagcatcaactgggatctaattaaactaaaaacttctgcacagccaaagaaataatcagcagagtaaacagacaacccacagagtgggagaaaatatttacaaactatgcatctgacaaaggactaacatccaaaatctacagggaactcaaacaaatcagcaagaaaaaacaaataattccaaccaaaagtgggttaaggacatgaatagacaattctcaaaagaagatatacaaatggccaacaaacatatgaaaaaaaatgctcaatataactaattatcagggaaatgcaaatcaaaaccataatgtgataccaccttactcctcctacaatatggctataatttttttaaaaatccaaaaatcaaagatgttggcatggatgtggtgaaagagaacaattttacactgttggtgggaatggaaacctatggaaaacagtgtggagattcctcaaagaactaaaagtagatctaccatttgatccagcaagcctgctcctcagtatctacccagaggaaaacaggtcattatacaaaaaatacacttgtgcatgcatgtttatagcagcacaattcacaactgcaaaaatatgggaccagcctaaatgcccatcaaccaacgagtggataaagaaaatgtatacacatatataccatggaatactactcagccataaaaaagaatgaaataatggcattcacagcaacctggatgaagctggagaccatcattctaagtgaattaactcaggaatggaaaaccaaatattgtatattctcacctataaaagtgggatttaagctatgaggatacaaaggcataaaaatgatataatggactctggagactcaggggagaacgggtgcaccaaaatctcagaaatcaccctaaagaatggacccatgtaacaaaaacctcttgttccccaaaaaattattgaactaaaataaaataaaagtcattttttataaaagaatctaagtatcaaaaagcccaggactttgtctgaattattcaacaaatgaataaagatctgatacatgtataaataagtaaatgatgttatttatcacctaaatatgacactgtctctctgactttaattttcctttcatctgcttatttttcttcccaagccatgaatatgggacaaaaaaaagggattaagacacaaacaccaagaattggcaagtataatgaggctgaacttgaaaaataacaatagttcaggtaaccatatattaaatttgtctcaagaatttattttattttctcattcatttattcaacaaatatttacatcacgcctattatgagttctttttgaaaatgcaataactgtctcttacatttgtaccattgtttatagtttacaaggtcctttctgatacttattttaacgtatcctcataaacaattctttgaggtaagcaggtcttatgaggaatgagtcttatgaggaatgagttaccagattaaggatcattgggttgtaaaaatcttgagctagaaagcattccatcgttttattgttgatacaactatatacagaagcccattatcaatctatttatttcaccacagagagctataatacacccattgaccatcagtaccagtatattaattttcacttctgggatttccagcctactcttagcttcaatgttagtgtgaatatttcatggtagaatgcacaaactttgaggaaggtgcaatgctttccctgtttcttccacttatgttcaggttctgcacatactgtatgttctccataaatatttattggtgaagagaacagttattaatgtaagaatctctctattcagaaaatatccaaggaaactgtgatagctgctggtttccaaagatggtcttccaatgaactatgtctctcagtattcggaattttgcataattccttccccttgatctggactggctctgtgacttgattataaccaacagaacatggtggtgggttaagcaatactcatttcatagggggcatttctggtcacatgatacttaatggtccatggtcaaatactaggatccagcaaagagccaagagctgtttctcaaaaaaaaaaaaaaaaaaaaagaaaaagaaaaagaaaaaaaaagaaaaaagaaaaaaaaagttatctgcagagtatggcatggctttgctcccagattctaaaagtctgttctggaatttacctaagaggcctgccaaaagctcaataggcactttaagcaccactgaatcagatgtgtcatatgaccaaagtggcagggaagcttgccaccctctcacaagggcttgtctttcgccaggccttattcaaaactggaagcctttcagattactcattcagcaaataggtttagactataacaacacacccaaataagatatgttgcctccaaaatccaatgaggcacaccagaaattgggactctttctttatggtaggagagaccagatgtagcattgaacttcaccttgaaagagatatctcaactttccccagaccatgaaaccccaagaaagttcctgaaggagcaaacttctaaatttttctgggatttatttcacaacctcttgcctctatgggtcttaccaaggtgtctaaagtagttgcgatttcctggtccaccagtgtagaggatccatgtggtgtgttgtgaaatgaagaggcaatcaatttcctgtggaatagaataggccagggttggagagttgatataaccctgaggtgaaacaaggagggtaccttgtttcacccttccagatgaaagaaaaatgcttctgatagtctctactaacatgtatatagaggaaaaaatgacttcccatatcagtattcatatattagatgtacatatattgatttactatagcaatgaaaccacatctggaacagcagctgtgattgtactcaccacctgattaagtttacaataatcctttgtcattcttcaagatccatctgtcttctgcacaggccagatagttgagttgaatggaggtgtggtgaaaatcaccagccctgcatcttttaaatcttttatagaggcactaatctctacaagtctctacagaatgcagtgctgctgtggatttactagtttggaatacaaaggcagttctaatgccttctacttgtcctcactcctcagatcagataatcaatgtagttattctgcctttcctgagtgtgcctccttcagttaagcattctagaacttgggaaataaccatggggtaagttcagagctaactggatgcaatatgagatggacctgagccaaaataccattaatcattcagcttcaataaacccctactctggtaaataggcaatagtagcatattgtgtctccaaggactggtatcatttcagagccaatgtccagaaatcccccaaaggtctggttatttacccttcccaaatgcactatgaccttggcaaatggctttaggtcttttcagggaaggaaagaaagagaaattacagtctaaacttttggaatgtaaatataaattagaaaaaatcctgcagtccttttggcaggcagggtacctcatcattttgttcctgccctgatatgggttgccaggagttgagtctagctataggcatacaaacagtgaaagatgttgggggtgagtcttgaggggtctcagcaattttccacagagtaagtccttacagccttttcaatcaagggaggactaaactcctcagagggaaaggctgcttctgctgggaaaggagacagggctttcaaggttctcagcttccaaagaatctgcctacatgttgccatctcaattttcaggggaggaaagaaggagaaattacagtctaaacttttggaatgtaaatataaattagaaaaatcctgcagcccttttggcaggcatggtacctcatcattttgttcctgccctgatacagcctgccagctctgtcccaatcaaagccctaattttaactgtaagaccttcaattgaattgatgttctaatctagctagctgcaggatcagtctttgggcttggttttttgaaatatcagatcttgcagctatgagagataagagtttctttcagagtagtcacaaagacttttcagtcccttgcctgcatcttgaactgaacattcaacactctgagtttatttctttttctccatattctctgtgacactttgaagcaacccacaaactccagtcctcatactccttacttccactacattggtctatggcagcatctacctggtaatctaacaccttgccttctataagcacttgatatcaaggactactgtgtcccatttaccattggcagtatagtcactaatgcttcatcgaatcagagaatcaacaccaaattcccatccttaaaattctatctctggattcacttccaacaccaatagttgtgtcagttaagagtcagtcagggaagcagaaccactgtgaatgatacagaatataggaatagtggattcgttgtggaatcagaccttacaaatgtgagagaagctagagaaggaaaggtctggaagaaggagtcagaagatcagaaaaagggtcattaacctgtctatcttatgcagtagcacagatggaccagacaggctggggcttgggggaaatctaggaagctaaacactttcaaccaccaaagtgggactgtgaaggggagctcatgaagaactgtatggagagtggttacctgtctgtagcaaccacttctgtgggtccacagccaagtagttggtgatgggtctcgagtcactgttgttcagcagagccaagagtcagaaagattcgctggatgcagagtgaaggaaagcaaggactatatgggacctaccaagcatctctccctctgtccatcactgtatgtgaccacagtgacttcctaagagtaatagttaccacttctgtgttctaactcttttcccatttcatctcttagccaatgctaatacagagcgatacatgaaaggggattctgagaaatgcagttgtctgcttaagcaagttgaccagcataatccagcacaacttctaaatctcagaagatagcaaatgtgggcagaaagaaaagtacagatgctccacgggttcactggtgatctttatggctgcaactgacctaggatttgggagatgcttggagagggacagaggggcacacaggaactttcctctcaaatatgaggatatcaatctagatctacgaggagtccttttggagataaaaagaaatttataggagatgatgaacaaaaggcccaatttctatattagactgtctccctgaatgagggtgaataccaagaggagactgagccaaggcctcagccctctgaattctaaaatgtagagaacttcattctgatctattttatacaaatggtgctggtctctcagacagtaccttttccgatgaaagaaagagagaaacgaagtagaagattcgtaacccagctcagtaaagaggcttacctttgctctttgctcaccatcattcccccgctcaaagtctcagctacctgcctctgtgcaatagctacacagtgctcctcaagtatctgcctcctgaacacagaattataactaacaagtatttaaaatttatgtatttggtgcacatctttcagtatgagctttttggcaccaactcttactgaatgccaatataaaagtaaacaatttgaaattattttaagtgattatcaaaaataacagcataaattctatgatgtggacttcagccacagtcccttccagggactcttccaggcagaccaaaagagaaaagctgtctgcaaaagaaactcaaagttcccaggaccaatagcatacttgagtcagatacagctccttaaaagacaagtaattttcagaggccctagggtaaactaaattagttttaacataatactatttaaacatgtagaaacataatatgatttataaactctatatgcttattgctcttatgccaacaatttaaaaatataaattaaacattcacaaagcttcaaaaccactacaacttcaataaataattttaatttaatgtaatgataatacttggctaaaactaaatcaccaggtttttttctttccaccttttatattaggtttaggtggtacaggtgcaggtttgtggaatgggtaaatatatgtcatgggggtttgacaagatacagattatttcgtcacccaagtaataagcatagtacccaataggtaatttttcaatcttcactctcctcctaccttccaccctcaactgggccctggtgtctattgttcccttctttgtgtccatgtgtactcaatgtttaactcccacttataagtaagaacatgcagcctttggttttctgttcctgcattaattcacttaggataagaacttccagctccatccatgttgctgcaaaggatgtgacttttttcttttttatggctgagtagtatttcatggtgtatatgtaccacattttctttatccagttcatcatttaagtcaccagttttgagtttaatagatgaaagatatatacgtggtgctgggttttgcttattaacttgattcttctcattttgtacataattttcatgcttgttttcctttgtttgaaacaaattcatattgaattgttaattaattcacttgatgggccaatcaatttactgtgcaccaatagtacaatactgaaagaaatatttttaacttttaatgaagcattctttactattgctaatcaactgtagtacagtgatttatacaaaagatgagctctacacagtacagccatgtgaatggggaatttagcaccaatcattcattgagttccccatgcttacagcatctaacttgttatgattctattttccaatgactgttttatattcaaattacttgacattattaggccttcacttagtattaaagtaactattagtattagcaaagcagggcatcaaaatattgtgacagtgtttgcttatagtttttcagccccaacgtgagttagttgtgttttatgaggggtatgtactccttataattttgcataatttaaggcttatgtttccgtggggaactggttcacagagcccaaatacctacaactttgtagcacatttctgttttgatgccgctctttattttcttagcattatctacaatatttagcaactgctcttttctaaattagtggtaaaacacatcaagggagttgtttggctttttctgtgggagtgaattatagctaacatctgtgaaaagttatgtatctgaatgcacattttccagcatgagctttagtaccaactcctaatgaatgctaatataaaaagaagtaaaacaatttgaaattatttaagtgattattaaacataatagcataaaataaccaagatctcttatagaaatgctcataaagcaacaggtggaacataccatactaacaatggctggttctttccattaaagctgaagtagctccaccatgtggcaggagtaaaaacaatctacgattcctttagcttgttcaccaactgaaattacgcaaatctcatttaagtttgatgagaaccacaaaattacccattcttctcagaatatatgggctattaatttttatatcacattacttaaatttcacataatttatgctgcccaactacatgttttagactaccattccattgaaaacacatttttaactccataaaattatgaagacccatgaaaattctagagatgcatatattccaagtataataaatatcacaaataacttttaaattcaatttttaaataattcttgttactattataatttccatacaggtctcagaagcatcttaaaagtaatgataactttttgtctctgtaaaaagaatactattcaaaaaaggacaaaaagttcataaatgtggaatactaactttgtaactaatatataaaatacatgagttttttgattcctaaattcttccaacagaaattcaaataatgtaaaatattggtatctttaagccgtaacttattaccttgttaatttcaaaacagcatactagtaacctgatctttaacattagttgttaccaaattatagtttttaaaaaatttcctaggaaagtacgccattttttgggtatcgaacatctcacctcataggaatacggggattgttttccttccactcttttgtattttccaaattttcaatgtaataagcacatattaattttatgatgaaatgaaatttgtaaaagaataaatgttaacattagaagataattaacaagttatctatctcgagtacaatatacaatacaaggaaattaatataccactttaccctggtggcaaggaaaataggtgagatatctttcccatcacaacataaaaatatatgttagtaaatattcatattggaaaggaatgtattctatgacctagcaattactgcgtcccagtcttggcattactcttattgtaaaagaaagcatgaacaagcagcaattttggggccataaaaagttggaaataacataatcatatagtaaaaagtgatatcacaggttataataagtctatgttccatatattaaaaataatgacacgaatctacatataatgaaaagagaagattgccaaaatgcattattgattgagaatgcaagttgcagaataatatatacagtattatgctatttatgttgataaaaatattgtacagtataaaccctaaatattgcacagcaaaaggactgtaagtacattgatgaattccctgttattagtacctgtggaagagggaattatattgtgggatgggagaacagtcagtggagagtttggttttaattgcaatgcttttatttttataataaggatgtattagcatattacttgcataattaaactttgttttttaggttttcttcttcaccatcgtatatttgcatgcatatacctatgcaaataacaaagtccacctttattggggatttgtgactggcatttttctaagcactttgtcatgtgtcatatattgtatcatgtaaacttattattaaccttatgatgctaataatatttttcccatttcacagatgacgaaaccaagcctcagaggaactgagtacattgcccaaattcaccaagcccgtaagggttacaatcaaactttgaatccagatatctgtctcagagtccacaatcttaaccaaaattttttttacaaattcccatgtagaagtgtgtacatccacatacagacgtacacacacacacatccctgctgtccagccttttctccccctgacacttgagtgcacaggtcattggcatcttctctccataactttccaccattgacagaaatgtgtttgctcaagggatgaattgaggtgaaaaccttacaacattagctcttttgtaaaaaatctgagcagattttttattttgtattttgttttcctggttacgcctctccttttaaagttttgaaaggtggcattaatatctatttctttcctgactgctccatttattagtttcattaggattagtgaattctacttggtctttccccaatccattaatattttttcccttcacttaaaaacaaacaaacaaaaaaaaaaaacacttgttttccaaatggctttggggtggtagtaggatttcctgatggctagaggaaactcctcatggcagtatcttggttgagtaattggtcctcgtctgtatgttcaagaaggtgaatgttcttagtaaacccagaggggatcagcccatcagaggtaagcttctgctatgtaaattgagacgagattcaggcttaacctcaaataccaatgcatttgctcttctggtctctcccttctcctccttattatcatgatactttaaaagccaaattactgataagaaatttgcttgctgagaacatagaaaggtaaacggctcgagagagggggttgtacatttttctttaaatctaaaaaaccactatgaagaatcccaacctcccaacaaaaattgcctctctgttaactggattttacctgcatccagttttaacacctctctcctctggacagtgctgacactgtcctcctgggaattatgacttccttagacacataatgctagagtcaagttggaacttagattctttttcttgcggaagtgggaggcattgtgtcttctcccttcatgcattaatttaattagaaaaacattcactgtctctcactatcagcctacagattctctatcttctcagcccggtaagagccttatcacactgagataaatggttctctttgttgtaccaaggtggttcctgaagcatggtaatggggaggagacacctagagatcaaagcaactaatacaatcaactccaatccagccccaaaccaagtctttccaccagctattcctttcatatctaaatgttgtcctcttcctctgcagcaggatagaaaatcaatttctaagtgtaaaggcagtaaacaaaatttcagagatatatagtatatgtaagtttgagtgcataaagttaaaagattcccaaatatctaaaaatgtttgaattaaaaaatcagtatcaaattagtaaaaaaaaaaaaaattaaaaaggtatgtgagctgtataacagtcaaatgttaatatgcttaatatattaaaagtgtatataaaaggataaggacaacactagcctgatggatatataggcaaaattcggatacaaaaattgtgtataaattactaatgaatatttgaaaaaaaacactgaaaattttaaaatgcaatgaagacagctataattcatatcaagttaacaactatttttaaacaatcacaatctaatgctgatgaaattcggcatattaagagcaattacatttttactgctatgattgcaaattgatacagtataacagtagattatttggcattaggtatcaacagcttttaaaatagtcatcctcttgacccaaatattggaaatctatcattaaaagggtcttctgagcagattttatataagcaaaatgttcattaaatatttttcatactttcacgtaatttgaaataacataactatccaacactagagaaacagttaagcaaattgagcaacatctacccagtagaatactatgccaccattaaaaattagattttcaagagttttaaattacatgggggaaaataaagttaacagaaaattgaatgtacaaaacggcctcaacaatgtcagaaaatatacttaagaccaaagactaaaaggaaatatgccaaaatgatgtagttattgtctctgggtagtgagataatagattatttccttcttcctcttctttttataattgtatgtaaaccacaatttcttcttcaatgaaaacatatttttataatgagaaaaaatgatctaataacagtatcttttaaatacaaggttatgtgccctgaaaacattcctagtttcccttaaagtcatttgtctaacataagtgaatttgtctgaatctctctagaatacacattcatatgctctaccccaggagcaaggagttcctaaaatctactccctactatgtaaaataaaactgcctttaattttttcctgaatttgtttcagacttcaagtagagttctttattatttctgttcaacagcacaaactacaaacataatctgtttggcaaaccatttttattcaaaagtataataatgccttgtttttcatccttccagaggacctagtggaagaaaatgcctaacatcagggaacagtaggagcagcctaaattgaccacagaattgtatttggccactgtcctcaaaaaattcaagtggattcagtaatcctgaatacttatgtacaacaagcattcctactataatagatcatgaggattaaaatgaggtgagttcattggtgagcatgacatgtagccatagcaattaatcttaggttccttctcccttaaaaatggctaataaaacagaagaaatgctgtatgaataatttcagaataacatggaataattgtagatatttctataagatttgtaccagatccactagaacaaatctaccagtagctaaacactgtagagtctctaaaaatggacaaggaggagatgtgacaaagatactctttaggggaataaagtcatcctaaaaactgaagatattttctgctctgccaatcaaggaatcactgttctttccccagcaagaaggagagtgaaaagaggaccaaattggaggccccaaatttgcattttaatcataacctttcatagctaattatgagatttgagcattctctggatctcagtttgccacccataaaatgatgggtggactgaaagatttctaagttttccagttctgacattgcatgggtctataaggagctccatcttggttggcccctgaaggcacctggagactttggttttagggaaccaaggagtctcagtgctgaatgaggatatagttccccggtgtagaattttagaaactatgcaagcacttggatctttaaaaaaaaaatagttggtccctgggctgtctcttacaactttaatatttacactatgacaaagtgaaagtgctcattcgtgttcgagccaaagtaataccattctctttattcattccaatgagctaattttacatgagcaagaaagcactggagaggtacagacccatgggatatttgcctagcctaagtgagtctcagatggaaataaatatgaaaagcgttagcatgggacctgtgagaaattgattcttacatctggcctccaaagggtcaagccacaaataagtgacctttgacatgccccttctctagttcagcctggagctgcccacatttcccagtggtgcccagtcaactcattctcctgatgcaggatcatcagagagaatctggagtaatggcagctgcgggtaaggggctgccaaataatagtggaacaaagatctcttccaagtttctatttcctccgaatagctcaaatacttcaacagtccaggtccccctaaagactgcattttcttagctgcattctctctagttgtgatgagtgtctcaaaaaggaacacctctcctcctgagtttatgatagtttatgacctgccacttcatttccagcagtgtgtcccagttcctcttgcaatccacaaaggacactttttctttcagtagcctggtgtgagctcttgcctctcaggattagctgtgatcttactgctggggtgggagcacacttagccacagggcccaaaagaactactgtcactgaaaagagcactttcctgtatttgagggctcttcctctcttctggtacacccggggaaaaacctggcagagtccacccacagtctttgaggattaattctgtaagaacttcttacactgaagggaatcctcctccaggggatgattctgctctgtgcttctgagctctgatggcaatcacatcaacatcgccagggactgtggcagaagaggaacatcacccactggaaaccggggcaagttgctcctctgtagttccaggaaatggccagaggcacagctctgctgttccaatttgcagttttctctaacatcaaaaataaaatgtgatttgcatttgaaattttacagaattcctcattttaggtcaagactggccttacccataggttagtgacttatgtggtaggatttaacacacacacacacatacacacacaaatattatccataaaaagaattatattcccaccaacctgctgtggcattcatcagtgaccctttgaagttcagccattgaaggggcaggttaaaatgcaaatttgtttcttggagaggtagcacatagagctattatcaactgtcaatgctccggtattgctggaatgtcagactaagaagtttgggttaaaaattaacatatcagtaagtgaagactggctttatatattacatatttaatttataaaaatggtgacattaaaaggtggcaccaaaatgtaaatagaatcaagatcactttggataaattaacgcatgacacaagcctttgacatgttattaatggaaatgagtttgggggatctaatttagcctttgagattagtgtcaacaaagaaaggtatctcctctggtgcccatggcagaagcagaacattagtacaattcaccatagatcagtttcactttgtaattcagtgtaagtggtttatatgatagagagggcaggaagatctggttttgactctgtctctactacttacaagatgcgtgaagctgctcaagtcacttaagcaaggtgagcctcaggttcttcatctacaaaagtgggatgtagaaaagaagagtaaatgtaaaattcctgttcagtagttgtctattaaagaatctctccttccttcctctattcacatccatcagggagaggagtaggctgatggtgccagctaaggacctcggcactcctagacctattcctgaaccattaatggctctgaatttgggacaggaatgttactctcatggttaattccttgctcacttgtctgctggtgcttgttcacaatgtcaaagatatggcaacttcatgggaaggcaggtttaactttttggtgtttttgcactagcctgtatatctgtctacctttcatatgagaaccaccttgctgattcagactggaagcttcaagagagaagtttctttccatttaatgcactggggatggtgctcaacagagaaccacactcaaatcggggctaaataatatggcaatatcatggttacaaaagaaacacctccctttctcaccaaatcactgaatcccttattctataaaaatgaaattgaactgcaaacatcaccaccatgacaagaggatttaggcacactgatcaactgattaaattctatttgtcatccagagtgatcctggaggccttcagagcctggaggaaacctctctgtgactctactcacatctttacacacggaaaatccaattaggctgagtatctacagcagcttccagaagtaaactgattgcagaagggcagcctgctgcctgaggactgcaggggacgaggaaggggtgggccacctggaagggacctctgccttctcagcacctagagttggtttccagatgatcacatagtttaacccttttcttttatagacaaggaaattgaggcccagaaaggttaacagtcttgcccaagacctaagattagaaggcagagttggggttgagaattgcttatgtgagactcagacccaaagcagacgaccatattttcaaattcagtgaaaactggaaaactcgtatgggcctacccagcctggaaaatccccatgtattaccaatacatagtaaacgaatcaaagattgaaaagtttacttgaaaaccaatcagaagtcctctcccacatgcaaaaatcccaccctaatagaacactcatcacccgtcagactgtcttaacacttcttcctttttctttctttgcaaacccctttgagcctgtgccagaagtgacggtgtctgccaccctctctgcagtcagtcctgaccagttctctggggtttacacctgtcctctggccactcgtctgctgcacttcctgcatctgcttgtttcaccttggccccagctttacctgaggggtgcttggcctgtgccttgagttccagggcctatgtttacttcaaaaatattaatgtcaattccttcaacttgttccaaagacaacagagcctctcacaagcaggcaagccctgccacttgttacgtagttgaggctgacgagcctgcaggtcccagccaactttatcacctccctcttctgaggggtggaagtccccaacatctcagggtcccctgagagtatggggattcccacatcggcaagtacctgcttcagagaagcccatgagaaactggcccagagcaagcgggtccaccctcccattgtgggaaagtgaagggcagaaggagtctggctggaggtcactcctgccactgatcttcctcactcgggtccagcctgtcagaggataaagcacagtggtgggtgggggtatctggctctcccccaccctccttctcaggggttcagtagtccctgggaacaagattcagctcaggaatttctgggatgctggtcagttctggccctaaggacactgggagtgacagcgggctgctaaggatgtgacagtgactgggctgttcccttcacatgactaccagggcaagccctggccaaatcccagcacctgctgaaagttgaagctgaccactggagtgattagattcatgacatgtggtggaggcctggggagtggagctactgggaaaggacacagctaaggaatctcctccctcccagcattgcttgaccctttcacaaagacagtggtaggtagaggaagaaggagaattggcctactccttccttttcgctgtatatggtcatagaaattgtcagaactttatatctagattcaagttctatctctagcacaattagctctaaaactttgcgaacgttacttaacctcctaggtcctctttgttcataaaacgagaacgtaatacataccttggttggctgtgaaagttatatgagtcagtgttgtggggaagttgaaggcatgcagtagatgcacaaggaaaattaaattccgttccccagttcctggcttgcaagttgggggttaaactcagttaagctcagagaagacatgacatgacgggggatcaagggagatgtgggaagctcacgggctgtggttcccactgatccacattagactccaaatgacaacaccctcacaatcccatgaaattgagcagaatttctcttctttcttgtgatgtttccagaaatgaagagagagggaaggaagacacagactctgatctttggcttcactttggttccaagacctggagctgatagtgtatggagggttgcctgtttgtccaggcactatgaataagaccaaggtaatccagcccaactctacgacacagctaagccaacaagcagctggatcttgtgtctcagcactcacagaaatgtataaatcatctgataccaactgctccccggaagcctctgtctccagaatataaatgtccaactacaggactggcaaagaaaccaagccctgggcaatgcctactatggacccttatttcttgtggtttgctaagaaaaaagtaggcccaagggagaggagggggaaaaccaggagggtctaaagttcttctgactgaaagaaaagaccacatcagagagaaagaaaggaatcagttaagtaataaaaggttgtgagttgatttatcattcaactaaacaaattatcttcctacacaaacattctgaggattaagtgaacaatataatacttttctgagctctttttgatcaaatgctttgctgttaaaggttatattcctagggagttgatactgaagcttcttgttccttgtcagtaaacacaaggagaggccaaccctctgtaaatttaaattacataaaacctttccccaaactgtctggtctcctaacagccccttttcactgaactctgtggttatggaatgtaagtatctttatcacagcagcacagacttttgaaaatttgacataatagaatttcttcctcacaaggcatatcaaacaccattgcaaactagtgggatttttaatcaagactaaagcagaggtcttttatttgtttgtttgtgcttagattatttccacatgaccaataaaatgttctctctgaccatcatccctgctgactagaagtaccaggaaccttgtctcaccctcacctccagaggtaagggtatgaacggactgtgaaaaaacacagcagaacactggggtcagcagagagaaagcgaaagaaccccatgggcagataatctaaaagcagcagagaatcaacgggaaactaacacaagtgcctgaagatggagacagcaatttttagtgattttggcttgtctctgttctatgaagctccaactcagtggcaacctagtgtgaaaatttatgaaatacttttggatttatctctgtaattccaggtctggcacaatataggtttcttgaatgaataaatggatgaacatgtcaatcaatgaatgaacagtaatattaaggaggggaagaaaaccattacaggtcaatgaatgggttcctagaagattcccctgtctcccattgtcttccgactcagggagacaacagctggagcagagtgcctagacttcgggggcttaggaggccacacatcttagagagcatttcaccatcaactgcaattcctttggcagtttgaattataatatttacttccatgatacagtcttcagctgttgtaactgctagtgacccttctctgaatccctacttcgtatgttagacattttttatatggagaattaatacagccttgactgctatgcttcttttttacttccatctctaataataagatcctcaagggtcgagactgtcatactcttgttttttgtgtttacttcactgcatatcctagagctgagtacatatggaagaatgaatcaattaatgaaatttatgaacacatgctgaggtttaaagagaatatcaactgcttggtttgatgacaaaaagcaacatcactctgtgtctagcacgtagcccagaggtgcgggccccatcctctcgtgtgaggagcccacggtgatgcataggcacctgcaccccgtgcctaaaccctgcagctggcacgggccctgtctgctcttcattcaccgttctcacgagttgcaataagttcagccctccatgtcacactgtgttttccatcctggggagtgtttcacagctatcccaagccccacgctgacgaatcacggccgaaaacacactctgatgccagcacagaccacggagcaaatgtcagacaagatcagcctcggaaaagtgagtcctgaattgcgatggaagtgggcttcctctcacaaggactttgtgtggagatgcgcaggtgggctgttggaaaagacccatggaattcccttcctctgggtgccttttctgtcccaacctctggggattcctcaagaatcggggggatttcagcacggagtgtgggactctgtctgccccaagatcagaggattcaccttgccttttggaaagaactgcccagtgtatcaggtttttatgagtcagttttagagttgggaatgcggacagatttgtaagaaagtccacagagcatatctctccacagcggagaaggctctcgagccccagaaggcaatatcacggtggcctaggtggatgtcacggggtgagaatcaaccctcagttgccacgaggaatctgaggagatccaggattacggtttttatgtaactgtcttacctctgtttcacaagggccaaaacttcagccccgttataaaatcaacagatgcagaaaagagacaagtggccactagatggcagcagatggtaagaaacgtgagttgcaggcgggctgggcaagagttaggctggaagcccctccattttgctttacatctttaatgagatatgtgaagaaaattagtcccttacatgccagacgcagatgccacagcatatggagagatgccgcacagcaatatttctctggttattaaacaggaggcacctaaccagtcattcactgcatcatcatgcagagttatcctttaggtctccggatactgttgttgacaaggtaataacagaagaaagcagttgagaagactgatgtcgggacgtgggcctctgggctcgtgggacttcaccatgccaggggatggggcacattgccagaaaatgaggagcagcccactggggccacttttccgtggccagggggacactgtggcttctgctgccgggcttagtcccagcaggcgtctgctgctctctggtccccctggcagccctcgggggctcatttattcagaagccccattaccgcgagacaattctgcggtctgacctttcaccacaaatcccaaatgggaaagggagctctgggaattttaaagagcaaaccacacttgcttctccagcaaaattgaaaagatacagcataactagagtgcattcaggtgcacatagatagggaaacacggtttccatgctgccccaaacaaaaggagggagtccagtcctgccgactgcaggaaacagcctcactcggaagacacactttttcttgggagagtgttcccaggtccagagcaggcagggattgcgcccacttccccacttctcacacttttctccaaccccaccactcagtctgactattcctttatttaattcttccacactcccaaacccaggggcttcataaggccttcagggtagctgaggaacagagaacagattattcagtccaggcaactagtccttgtctcaggcccaacaagaaactgttatcttattaacctgaaagcccagaactctcaggacttctcagagtcactcatgaagccccttaacagtcctgaaatgaagataaataatacagccatttttcgtacagagaaactgaggtataaaactgagatcagctgcagctctcctggtccccattgctttcccacagattcaaccctctgaagcatcctccagtgaaaatgtagtagcaagattcaccctaccaggatttctctccccctcttagaaaattacttcctgcgctagaaatcctcacttgtctgtgtgactttagacaacttgcttaacctctctgtgcctcacttatcatctgtaatttgagggactagaaccagatgatgactaaggcccattccagctcacagtcttgtggctaatttcccagtcctctgccagccctcaaagagagttgtatgggacactttttccagcaacagccaaactcaacaggagcaagcagaatttccttctccaattgagaagcaatggggtggtggttggagtcttgttgatgtcctttgtcctcggagtgaggcaaacagtgaggcttcagatgttattggcactaacagcagggcctggaggtggccacactcttgtggaaggaccatgcagagctgtccctgtgggcagtgtaggtgcatagccaagactgagggatgttttaataactacttctcaataagaagtcctattttattctgcacaggggtgtggacccaatccaggtctcccaggaggaatctactctcacccataataggggattggttcagctcagctgcgctcacaaagggctatacagcatgcagcagtacaggcagctccccgcagctccatgtgaaaatgactcacagcagttatgaacatcaaacctcctttgatgtgttcccagacatgaagaacagccacgggaggaggagacggactctggttgctagctctgtggggtggcgcacagagggcctggacacatctggtaccatcctgaagctccaggagaaattcaggctgggtaattacctaggacttcctaggataacagagcttctttcatctatctctctccctccctctcactgtctttctgtctccagctacaagggaattagattctccaaggaattacaacctgtttctgtaccttcacctttcccgaggagataacaattcacatccctgaataaaagttgttttattgagcacaaaatgaatgcacccccctcgctcagcatctgtgccaattgccttaaagctatagacctggcctccatcagccaagtgaaaggattttcctctgtcatggccatttccagactctcagccttttgagtagccacatggtaccttgtcctcctaataggctctcaatgatgattgaatacaaaggctctaattctctgttgcattggcagctcccaagactgggtcgatcacaatcgtccacagcagaagacagcggtgctgacggtcaaatgagcatcagggcacacagcagaaggggagggtcagccactgtcccttcatgcccatttcaacagaaagcttatttatatgcaagaggtgttccccttccagacagggttcaagagcacattggtccctggaaacttgagcaaagtcttcacggttatagaagggagtggcaaaggacatgtaggagagaatcagttccaccccatgcctgcacatttcattttctgaaatgaaaagctctcatacactcacagagatctgcacatacccacacatggaaatagcataaacagctactctttactgagcagtgaccacgtgtcaggcacaatgcctcgggcttcacatgcatcatctctaatcctcatcgacgttctgggtgtgggagtgaaggcatccctgttttatggatgaggaacctaaggtcagaaaggctaagaaactttcttaagattgaacaactatggtagaagagctacaattctagatggttggattccaaagcatcatctcttaaccactgtactatggggcaatatgcttataagcaagtgcttactctgttggaggcactggggttatgagatagtgcaggaaagacatagttattcacttcgcaaagcttcatttttaccgcacactcatgcacacagtgctacacacacacatgcagagttactataactgtggtgtcttccaagagccctgtcactaaggtatcctcagtgtcgtactctcagtcctcctgcacttgaaccacagtttgaattgtgcatagggtaaagactgaggtcttctacagaaaggcctaagctgcttgaactttacagacaattatgtgagcaattcaaccttttatacattatgctgtagttacccagctcctgaactagtcatcaggtattttatttgttttttaacgtgatcaggaagtttctctgactcatttctctatctttgcagaggaacaaggtaggagagcaacaggggcaggaacagagaggatttcaagcttgatgaaggttcagtaagtcaagtcataggtcaactagaagaaataaagcaggggaagatttggggtggggctgaagctccattgtttccatgacaccataagataagtggtgatctaggtgatctaggtgtgcaaaggtgaaacaaaacgaaagacgcaaacattgtactagtttcaggttttgccaagagcagattggctgccaaggctacttcagccttgactcatatagatccatgatctgggaggcaagacagcgtcctgctgtgctggacatctcagtgacattgacccaactgggggaactccctgaggttaagaaaacctccctccaaggctgagttaatgaactacctagatgtaagacaggagactgaaaacatttaagtcccaggaaaaatgcagacttaccttcttatgacctagatctctttgcaaatctaatgaaaaaggtttgttatgcacaaatgtttccctccaattttatttcaggagatttgtgctctttcctggactgcccctgaacctggaggtaataattctagatcaaagtctccctagaaccttgaaaagggtggactgagaagactggatatacagctctaggcaaccagtcctccactgccaccaccatgctttctaatctccaggggagcctggtcatcttgctggacaattgctgtttctcctgacaaaatccaagttaggaaactgacagggtctttgtttctatttctctctatgcctatctctcaaggtgccctgtcattaatgaatcttaatcctcacttttatttctcaactctggctcccaatttctgttttcccacccctcatctgggggagccacccggaaccccctcattaatccacagacagccatctcaggacttcatgctaagaattcattgtttcccactttcctgcatttgaacactggagggcaatgctggaccagccaaagcactctaggtgctccgctccatctttgtctcaaccttgcctgtcatttcaggaagcagcctctggttggaagccaaaaccaaggaccagtggagcgcccataggctagcagaacagctaggtctattacagcatctcccccacacgggatcataggaataaaaggtagctcacggaaaagcacatctggtttcatgggtgacacaatcccctgggaaagaaactgagcggggtgcttgcctaactgtgtcattaaccagaaacaatctgtgtctctgactaggggatgcagattcctacctgtcttcactcactcagatgtaagcccctggagggtaatgtcttagtaaggtctgcattcctgtagcaagcacagtgtttggcaacaaatacttgctggatgaataaatggatgaatgcgtgtatggatacatatgtataaaatggaactggccattttcagatttgttgttgttttctagctcttatgacacccaaagtttaaatcattaatcagttgctgagcattcttagtcttaaagacaactaaggatggtcaggtggttaattaaatcagtggttgtcattgtacaaatgttatttcaaacaccacttcaagagtttcaggtctcttatttttaggaagtccttcattgtgtcatccatgtgtcctcagacctcaccagcctgtggattacaaaatacagacactatttcattaatattcaatttacaagaacctgcgggctcatcatgtggaatattgagtatccgtgatgtccccaagtgatttgtgggcatttcatgtgccacagtgggtccccacggggcttgacagttccatggagccagagctcttcttcaggccatctttcatcatcttgtgagacttttctccaggctgctctcccctctaccttcaccacaatggatcccatgtcaggtggacatggtctactctcttaatcattcaaagcactgctaaatgtttgaggaagaaagaagagcacattttgagacccaaaacccaacttgagactctttctacctccaggcaggcttacgcatagcaaagaccagctcaaggcgcccggtagaagtctgcaggcatctccatatctccaagtgcagagagcagaggagattttttcttctcagtccaagactagttcttttcctgccctgggatgattgacagtgagaaaaaacatttcctccagggaagcgctctacctgcccctccaccttctcagacggggcccgaccttcatgaccccgacaaagcaaacctggtgctcaactgtcttattagatcttctaacactatgtgtgtgacatcaacagccctaactaaattcacacttgggaaaaatatgcccctcattctaactaaacagacaccatttaattttcctaacagaacacttactattttgatgcacgacacctgttttcagttttatgataacttcataatctccaatacaatgagtgagtgtttatttgaaatgagaataacctcattctcaactagttttctcaacagaagaagagtgctcaaagttcatctagggtctttacctacagaaattcaatgctgtcagcaatcttcaaggagcagctctgccaaaggaaaaagaaagaaagaaaaaaggaaatcctgcttttataagttatccctattattaaaatttctaacaaatctctccctacagttcaaacctaggtccccagagtatatgggcctcatccttctcataaaaatgctgttaaaaaaaaaaggtgtcctttgacacctttcctgagtgcaaacagagattgaaaaaaatcattctaaaataacatttttctgtcactgcccaatgggaggtgagttgatcataggtgaagcatgtcctattagtatgtcttgctcaggatgcctttggtgtgagtaagggatgggtttctagggcaaaatctctgttctatacccgcaaaaaacaatgtacagaaatttccctaagagaggagattggcagtcaatacataagactccataggcaggaagtgtccagggtcagctccctgcattcaaatacagacctgcatcagggctgtgatttccaggtccaaggctcggtgagtggataatacctaaggcctgatgccaggcctgatgtccaggtttaacactgatggcaggccacagaccctcctgtcttgggattccaaaaagcccagaatctttcccagttcctactgacactaacttttgcccgggcaagaagtgtctgagattgcttcccttgagaccatagtcctttcttataattccaaaactaagcagccctgtttatgctgctgtggcagagcatggaatcttggttagtccttccaaactgcacccattgggttatccctggggaaatgatcacattacgctactttgttgaacactgaggactccaataaggactgtgaatcccaactatttctggtgtgggagccagggctttcaggtcattcaccagaaattatccaaccagaaaactttctttcaagttctgttcaaagtccagcagtttgcctacaggattcagatgagacttctaagaatcatctgtgtcttggatagagcaccctggcagcctcttgaaaatcaattccctaagaaacctatcttttagaaatggaccttcacaaagccagtgagagaatgggaggagtatgtggtttccaatgggagacatatatagacttttatgtcatgaatttctgaagtcagaccgtgacaaatgttggtcagagtacaatgcacagttgcccaaaggaggggaaattagcttggttcaggaggactaggaaatcctccccatggaagttttagttaaagtgacttaaaggatgaatgattttgacaaatgagggattggagaaggacatggcgggcagagggagtacagcttgagcaatgtccaggagggatatagaactgtgcttggggaacagtgatcacttggtgagagttgagtctgcctgagttggggcagtggagtggtgggagtggtgggctgtggcttgactgagaaagcttttgtgaatcacattaagggactagattctgttatatgggaaatgggcagaaatcacaggcatataagaggaaatgtgcttcaaagagtgcttggaaagattactatgggtgggaagactggttccaagaccggaaacaatgagatcagatgtaaagttaatatgaaactgaggtagacattgagaaggatcagaaggacttggaaagagaaaacagatttaagaaacacctcaaaaatagataaatgatatgtgggaatgaaagaaaagggagagattgtctcttcccgacatcctggctatgtactggaagattccctagttcccaagccccaaggtcttaccattagaaatcagtccttactcatttgtccattaaggcttaaggtgtcaatccttccaggaatgcttttatgtttctatggtccaaaggcttaatctccagtggcagaatgccaggtaccaatagaggagatttgggggcagtggtcttctcgggaccctcaaaaatcattacatagttgcccactcctcttatttataaagctgttcgtgtgaataagcacccaactactttgtctgtgcccatttgatcactgattgaataagaaataaaagccaaacatctatattctttttcttctctgaataatcttttcccctgtcttcagatttggaacaaggaaacccagatccagggaaaatattctaaatccttgacctccctatccagttggcaccccagcccagtaaaatggcttcaagtacaacattcccccaacagcaaagacagccttcctgggagtcttgggtaggcctgtccagggccaccgtgcagcacacatacatcttcccaaccagctccactgtcacaaacaccatccacactgccatgggcaagcctctggccaccaatgccaccccacctgctctggtgtgggcacacctacagccatgccaccaacactcctcgtgcacatgtctatggtgtatctgtgcagtcacagttgtcaccagctcaattctgtgtaaccctaagtccaggcatcttggggtgaatgtctccttattcctttgtccattgtcctgctctccctttaaaattgttcatgagtgtattttgcagaaagatatgtgatcttgaaagacagagaaggaaagagatgaagtaggagagtggcaggggtgggggtacagattttgagaaaggcaagaaaaaagaaaggatccttgacctccatcagtcccaactcccaaaataagactggccctaaagatagcttattatttatcccaaattaaaattttatggctctgcaatcattgtgtacacagtgaaaagaaaaccatcacacaaaagatgcagttatcctcacagtgggaacaatagcagccaagctgattctgctccaagaatagaataacagtgctaagtcaggaactccaaaactttgtcaacaaatagaataatttcttggtgggaaaatggctatgaaagaaggtgggcaggaaagcaaccttctgactcttgaacttggcatgggttgccagggaaaattccagccttggtccctccatagtgagctcacaaccagctctgctgactggggaaaagtcctgcctgaatatgcacagactccagaaggccctcaccttacccttgcccagaatcatatacagaatctaacaggctgtacctgcttctcttgcctaaagttatgcatcattaccagatttccagctccatgatggcagaaatttcagctgatttttttttccattgtatcctcagcattcagcagaaggtttgtatatacttggcactcaataaacacttgctgaatgaacggttgattgattaatcaattaattgattaatttaaaatgagcaaaatactttctccctgtctggcttctgaagagtgagtctgagtactagaaactgtcagataggcaatagaagccacagtccacttggaaaaatgactgtttctacctttgctcatccttctgggcatcttagattcctgaaattcaggaacaaggacccaagagatcatgacccaccaagtgtctttcaacaaaagactattttcctggctgtttcctttcagagaataagcctcctggggctgataagcgaatggcaccatatgctgaaaacacaggccctgagtggcagagggcaccagagcctcctctgaggagcctgttggattgcagcctttcaacaaatctgagtgtgtcttttgatagcatcagcatcaaccacccccaaggacctctttcttttattgcttcagcaatgaagcagccacatggctgttgtagataaggtggcccaagtgcattgtgcatgcaatgtaggctgctggtgcacagcactgagaatcgcagacacgccgtgtaccagcttctctacactgcgttgcccttcctctgtaagtggcccccaggtaaacgggtgtgattccccaccacttctcatttctcattttctatcatttttttctttgccagatggctcctgcaagactgaaatcacacagccttccaacatggccacaatgattgggacagatgtcaagttccaacgctaatataacattcctgatgggaattatgattctttgtgctggcatctgcaaagagctaaccaaaggtttacctatatctgctatcctttcaaggcaccctggaatcagagcactgctagttgtctgtggacagaaaattgttctccagaacccgaatccttaagcatgtgcagccaagagactgagccatttactgctgtgcactgtgggcaccatgatgcatgctggatatcacactgaacaaacactgtaagcctcaagcagcctcaacacagaaaattcaaaagatccaccaacaacacacagggtgtttagtgtcatcttaaacttgcatcttgaatgcatcatcgattcattcattccaaactaaaagtcccttaaggctttcaaattgatgtactgagtattgtgaaggataccaacatatataacaaacacttctcaaataataaaatgtattcagcaggtacaatctcctcacttttatgttgctaaaccatgagaaattaaaattaaatcctgtataattacttgaatcttccagctgacaaataaaagtagtctttgatacacagaaggacaaatgaattgcacacacatacaaaattaaggccagcaattaacatcttaatgacatacccttaacttaccaacatttctaaaagcctgaaaaaatattaaatatctatgtatacatgatatgtacagtaaatttatagatagatgatagatgaatggatacatagacaggcaagctgtaagaagcatcataaaaggactgagctcaagttcagactttaaagccagacttcttgagttttgaattccagaccttccatttactgactcaatagctatgtgaccttgggcaatttactttttgccttgctttcctcatctataaaataatgattacaataacacctacctcaggggattgttgcaggaattaagtgacctatagcacatgttactgtattcagagcaaagcttggaacatgaaaagcactcagtgagtattaactacttttgcttttgagtgtgataatatcctgaggatgattactaaatttcccctgtgttgggctgggttgagcctttaggaagttgttgataagaaatgtcagtctcttgaacaattaaacattattttctacattagtatcctatctagtaagaagtaaatatcaatggaaattcagagaaatacaattcaaaaggccttcaggacctttttcctggatggcaataaattattgagggcttcctatgtagaaaaaaaaaaaacagaggaaagtaatttctgcttgaccatcataaaataagcaaatataggctttgcgagatattaaaatacaacagtaaccccactcattaaatgaatagaatagtggaataatgtataaatttaaagccaaaagtaaaattaaagttgtttatgcacatatttttgaagtaaaatatttgttctatcaacataaaaggcatagtagatgacctgaaaaagtttccacctccaagaagataacaaatcaagtcaaagtcacagtatgcctgacgttgtgtcatcctcaaaaactgggaagtcaggatcagtccaagactccagaagtgaggaggctctaaaagacacctccacttcagcctctgcttattcaaggccccagccatggaaactcgatggtgtgaactgctgagctgagaactgggggtaagtgaggactgtcttctctgttttcttttctgaagacgcagggtctcctgctaattcggattctgtgttttattcattagtgggaacacaaatcccctgctatcttgctagctttctcatttgcagccaacatatgggtttatcagcacggttagccccccaagaacagcccttcagggacatgggataacacaaaatgggaaattcttcttggaataaagagttggggaaggatcctttgtaaaatttggttttggggtcagatttcaaagtcttaaccctcatgggacaggcagagactcggggatatttggtgagtgactgagtccctattcctcctgagcttgcccttccccagggcacctcagagccagaactgctgaatgttaacatggggcactcaggtttcctacaggacacttacaactctggtaaccctgctgtatactctgccagtaaggaactacttagtaattcctccgagagccaacattcaaagactaatgccacgtcacatgcaatagggaaatgcagctctatctgtcattcacatctctgattctgtcattcattactccatgctaaaagtcccagtgggagaaattgtctttcttctttttcaaaaccagcttctactgaaggtaaagaaaagtttaggggtagaagaacaaagtcattacagaaccatgcattgattggtgagcactgcccaggggcaggttttgtggtaatgatccataagaagcaaagcaaaaattatggtggagtcgatggaatatttgagagtctctgccccaaccatctcataatcgaactgggagccctccaatctccccatgcaagccttggaggacagtcatagaagaaaaagtgagcaagaaggtttaactagctaacaagtgttcatcaagtatccataaatctcagggtacagaagtggcatttttgtattcaatcatgtatatattagtgtttgctatgtgctgtatcccatgccaagatccaagccttcttccactgtgtaactcataccgtagcagggcttacagtctaatagaggacccaaatcagatgcttgtggaaacaagagaaatacttggttgtaataattatgggggtgttccaggaggaaagtacagattgaaattagaatatttcaatttcaggatgagttaggtgatgggagccaagaagacatgctaaaggaattaaatcctgagctgagactagatatgaaaaagtttgtttatttacatcccaagttcccaagtcagtaacagaagcagaattacaactcgagaaaggccccacttgcttctatgctgttttgctcagcagctgcttcctttggtggcacacagctgggaaagtgagtcacagatggactattggcagccaaaatttttttagagacaaatgacactgtgatttttcctgacacccattgaaattcctcactaatttccaaaaatatcttatgttgttttaaaacatccagtgaggcccagacatttcagtagaacaaatcagagaaacaaagttaattccagccatctgagcattctgagcccaaatcagctagactgagaagaagaatcgtttacttaccgaaggcagtcccaggacacccagcagctaaggtcctgactcacagcattctaaccaagagaaaacacaaacacagcatcttctcttttcattcacttctgttcctgttcttcagttgcttgtccaaccagctggagacacagcagagaaaccataaagcaaagaaagcaattaggaacaggagaaacagctgataagcactctgcctaggtagaggtgaatcctgggcacccatcagggaaagactttgccattactaaggctttaggtgaggagtttgagggttacgaataagagataaagcaaggaaagggcttttctttgccaaatttatctttttttcacccataaaactcaaagaggatagggaaagaatgaatgtattctcaaatcaaaggaaaaatagttctaaaacttccaatgagtgagaaaatcagaagttctggcactgactcccatttatattgaagtaatactatgggtaaatattttatatcaaagaccccagagtggcagagaccatcagagaatggcattaaactgggcacgcatagtagccgatatggggttaatttgatttgaccttggcatcttttctcttcttaaagtcctcccatcctttctttatcctgtatagacaaagaagactggggtctaacttttatgtgtcttccatcctaagctgccagagacagtcctttgccaaagggcacagtagattgatactgcccatatgtctctgacacggctccactcagctcattcatttatctacccaagtcctacggcagcctaacatggctcaacagactgctgtttccctcagaggaatgttctgtgccagccttgaaataacaagttctgtgtctctcctggtaactatggctcaggcagggggctatgaccaggtcactaaccccaccatggcaaagaagaaaagacaaggcaaagaagccaatatctgtggagggcttacaaatgagtacctggcacaggaataagcccttcacaagtgttctctcatttcaacctcacagcatccctgcaaggtaactataattaccccatttgcaaataaggaaatcaagactcagagttgtaatttgtcccgctactggtaagtcacaaagcaagattcaaaaccatgggctagtagacctgcaaagtcagtgctccatttacatgtaggtaatatgggcactgataccacctaggcagtgagccacaagctattacaagcaggttctatccaagtgggaggcaccttgctctaggtacctagcaggttctatccaagtgggaggtaccacctgctgcagagtgccccacttctccctgcacctaaaacagtggataaaagacctggatttcccatgttttatcctgagttgctggcaaattctttcctaatctcagtcttcactagataagcaaccaaccctcttggttccttgagagttggggcgtctagaaatcctgcctggactagcaaatatctgtgagttcctaatattgaccagctctgcactggacattaggaatgcaaatataaataaggtactgtttatgttctaagtactcttaaagttcaatgcaggaaacaaacagattatcagagaatagaggtgataagtgtcatggcccaacatggcagggggccaggggaacgcctccctcaggtggagttaaagaagggagaagaaggatggtatggcttttccaggaagaaggagaagccagtgtaaaaactgagcatctggaagtctatgacacatctttgaacctgcaagtattttatgtggctaaagtgttgaacacaacactttcctacatctaaaatgtgcaccacacctgagatgaggctgcccgatcattccaacagtaacatctgataaaagaggccaggagttgaagtgggggcaaggggcttatctttgcagttggcttagaggggccttctttatcagttgaagagggcaggaaaggctgttaggatttttgtggagagatgttgggggtggggggtggggtgctgcacctgtctctcacaggctcctgaagaaaggttgaaaataacagcttttaatactgaataggccctctcattgtggaggcaggctgagataaacagaacttttactatcatgagtgctgtagctcattgcagtctttattgtgaaagtgttcatgtgcataagtcagataaagcaaggatggttttccattaccatcctaatcaaaatttccaaagcttttagagatagctttaattcttactctgtgaagaaggatgaatagagtcattttctgaaatgtttccacaactatttcaggtattgagtgttttatatcttcccttagctgccgaagagtcctggggatccgtaggggtgagcaggaaggggaaatgcacaggcttccttcatgccagttgctgagagagagcttagagacaaatacctgtggtaatgtggaatttctgagttgagcatgggtcaactaaattaaaataaaaatttttattcccaagtctcaagttgaaatgggtaagccaagaaggtctgagaccgcagggagaaaactcctggaggaatccactaaggagacaagtaggcagaggcgcttaaagatacaaacattaaacactcacccagggaatgccttcatcctgttggctctctttgttctgctcaaatatctgtctggcatcctctctccacctaaggttaaaattcgggcattaggacataacgtaaaaattacaactaaaagtcaaccctcctgatatcttctattcaacatttcttccagtgcactattatcttcatcacatattttttatagggtacttactgttcgtggtattggaatgggtcatgggaatagcaaagttctaaggcaagttctattcaaagttctattctcaccaatgtgttttccatttatttttaaaagacagggcattagaaagtacaattaaagattacaaagaatacaaaaatataacggcacatatgataatgagggttagtgatttcatgtgcagtgctctaggagtttatgaaaggaccaattgctataagaaaatttcttaggttcgagactgcagtgagctatcgtcacatcactgcactctagcctgggtgaaagagtgagaccctgactcaaaaaaaagaagagaaatgttttttaaaaccttttttgcttttgtaaaaaaaaatttatttgtatatacttagtgcaagcgcaaatttcttacttgcatatgttgcgtagaggtgaagcttgggcttttagtgtacccatcacccaaatagtaaccattgtacccaataggtaatttttcaaccctcactcccctcccacctcccgacctattggagttttcagtgtctattattctactctgcatgtccatgtgtacacatcgtttagcccccacttataagtgagaacacacagtatttaactttctatttctaggaaattttacttaggataatgaccttcagttccatccatgttgctgcaaaatatattatttcattctttttcataactgtttagtatatataccacattaagaaaattgtcttagaatagctgaagcttaaaagaggcaggagttggataagcaggaaggaaaaggaagggtatttcagggtgggtatactagttatctattgtcacatacaaatcacttcagaacttagaggctcagaacaacatttattatctcagtttccgtgggtcaaaaaatccaagtgtggcttagctgcatcctctggctcaaggtctctcatcaggctgccatcaaagtgttacctagggctgtagtcagctaaaggctcaaccggaataagatacacttcgagttcactcatgtggatgttgacaggctgatatggtttgggtgtgtgttccatccagatctcatgtttaaatgtaattcccagtgttggaggtgggacctagttgaaggcactggttcatgggagaagatcccttatgaatggtttagctccatccccttggtgatgaatgagttctcgctctattagttcatgagcgagctgatcatttaaaatgagcctggtacctcctcctctctctctcttgctccctctctcaccatgtgacatgtgcccaggctctcctgccctgactacagagaaatggacattagatgtggtcaaggcatctctagagcaatggttctcaactctatccacatatttgaatcacctggggatatcctttgaaaatactagtgtctgggatacatctccagagattttgattgatttggtgtgggcttgaagctctggcttaccagatgactcaacctccttcccctcctcttgctcttccctccccctggggttgaaagcaactggcttaagaccttgctattccaagtgtagtctagacaaacacaatcagcatcacctggaaggttttgagaatgcagaatctcgtgcaccatcccagatccactgaatcagaatctgcattttaaacaagactccccaggtaaattatatgcatattaatgtttgagaagcactggtctaggcattcgtcattattgaaaacgttcatggaggtaaaaaaaaaaataaatcactctttcccaaatgtcacccaagaatccatacttgtaaaaaatctcctgaagggatactgatgtgccgccagggctcactgataggcagtcagtcatccccagttcagtttacagattatttgtgttactaccaatataataaatattcttattggggtgatagtgagtccttgtatgcttcttagaggaaggtattacataaattctaggttttatcatttctcattcatccacaagcaaataaggaagtggattaatatttactgagtcaatatactttttaccacaccacgatggattatccatggaaacccagaatcttgtgccacataccttcaattcaagatcaagccaaaaaaaaagatccacaaattattggtgtctgattaagtctgattgggaagaagaggaacaagagacacaagaatgtgtgcgtccagtggtccaatcctgcaggatgaatgaggacatgaagttctggcccgtgatggattggggtaatgtagaaccagaggttggcctggggttagcatgaaaaatagcctagagacaaggaggaggaaatcctgggagaaaatacctggactgcccaacaatctgagggtctgcgcacaatgaaaaaagaaaccagacaaaaattaaagtaaaaaacctggagaaatttaaataattcctgtgcttactagcaggtaattaaggaagcattttatgtaacatctgaagcctcagatttagggggagacagggccactgaaggccctagcatagtaagggcatggaccaagtttctctgcagaaatcccgaagccaaatgagcgatatgaacacccactattatttttgtattattcattttctttttttctttctttcttttttttttttgaaacggagtctcattctgtcacccaggctggagtgcagtggcgtgttctcagcctaccataccctcctccttccaggttcaagcaattcttctgactcagcctcccgaatagctggaattacaggcacccactaccacgcctggctaatttttgtatttttagtagagacggggtttcgccatgttggccagtctggtctcgaactcctgacctcaggcgaatcgcctgcctcagcctcccaaagtgctgggataacaggcgtgagccaccgtgaccagcctgtattgttaattttcttccccctccactggtaaggacaattgagagttgactaaattcttattattgttgcctccactgttctgctttctgtgattcttatccatcatgagaagggctgacttggaagagttcagagcagtgaagagaaatcccagagagtgtctgccaacactcaaaaagactttgaatttgacgtcagaataggaataggcttgccactctcaccagcctcccaagaagagtcattgggcaggctggatggctagaaaaagaagatacctgtctgatgcccaaaggcagctagaaggcatcctggcttcaggaacagtgccatcacctggctgccctcacaaagaggtcatccaacattgtgaaaccatgactatgagtgaaaggcaagagaaaataagggaatctgaaaccatgtgaatatgccacttcctctgcatcacgggacaccagagacgggcaacgaagagaatgttacttctatcatataacacattctcgattcggaaggtgccacagccttgagaaagtcctcattacaccatcttgaaagctctcagggatgatataggtagggtccaaataagaaaatggactcaaggaaatccaaattgtgaccttcactttgaacaattaaaattttaaacagaaaattagaatcgttgaatttgaaatccagaaaggatcttaaaaacaaagtaggaatcccctcattcagtttaaatgttcactaaatattgaatgagtaagtgatcacccagcctcaattcaaatattttcaatgacaattcttgtttcaaaaaatctgtcctataccaaatcaaaatttgcctcccataacttcatatctttatatttgttatgccttccagagcaacgcagactaagttcaccttcgcatattcaaatatttaaagatagctatcctgtataaccattcctcatgactgtctaataaattttaaactccttgagagaagcatccaagttcaatatattttcctgtaccaatgcaattcttaatagagtgactcatctgtagcgggtagtcagcaaatgtgagttgaatacatgaattaatatctatgtgtccacctgaccaacagttctactcgggtgtctcaaaggcacttcagctcaactccaagacttaaatcaagatcttccttgcaaatatggccctagcctaagattccctatctgaaggaataacaccatcatttcaaacccatccactgctctccatccactgccaccagccaggtcaaaactaccattttcttctttggattgtttctatagccttttgagtaagttagccggcctctggtactattcagtatctcctccccacagcagccagagtgatctctccaaaatacaaatatgatcatgtcatgcccctgattaaaaatccttgagtaacttcccattgcagataggcaaatgaccaaaatccctaaaagtcctctaagaccttgcacagtctgactcctcacctcttctgccatacctctcactcttctctccctcattttccaaacatgccttcttccatctattaaatacttgaatgtaccgggtgccttcccaccccagggtctttgcaacacttctcccactcctcatcccctgtttaactcctattgaaaggagttaaacaaaaaagatcaaagcctacacatccgcttttcagaggcatcttgagatctcctaacaatttcaggttgtttattctttaatgctttcatatatcagtttgtaatattttattaatttgattatgcctattttctcatgagtctgtaagctctggagatcaaggactatatctgcatttgcttattcaacctgacaaatcgcataaacatagctgtgtgaataaatgaatgaatttcccacattctgggacttcccagaatttgatcatcatcacagactctgggctgcagtggggcctcaagccttgccatattctcactttttaggggtctcggagactccagtgtcatcctgagctggagtccaaggcttcttagaaaccactgatttctactcattctgtctggcatactcaagagcccattcttgggcacacaggacaactgaacaggattggagggtccttcataggtctgagccagctcccacatagggaccctgaacaggtaagtaaaacctgcccagagagtctagctagacatgaagaaatcagaggggcccaaaatgattattattttctcagtgactactggctgggcttatgatgatccctcttggtgtttttcattttgcatggctattttcagtagctgtatcattaaaatacacaagtctataattatggggatgcatatcctcatccctcaaatatgtactgagcacgcacaatattcctggtcctgtgccacacgctcggttacaaaggcagccaaagctcaattcctgtcctcaaggtgctcttcctagtggaagaaacagacatgaaaatagaaacttactaacagagaaaggagcaaacaaaacacagagaaggaagtgatggcctagagatggggagggtgtctcagaggaggtgacacgggctcataacagaaaaagcacttgtttccccgaggtaaggtgtgcttgcaggttccttaagatgacccaggagggaagatgagcatcctcaacagttacacacaaacacactcaccttcatctctgatgcttgcagtgaaaataaataactgaaaataggcccaacgtgctgtctcatgcctgtaatcccaacactttttttctttgtttgtttgtttgtttgtttgtttgtttgtttttaatcccaacactttgagatgccaatatgggaggattgcttgggcccaggagttcaagaccagcctgggcgacaaagcaagaccccatctctattaaaataaaaagaaaacataaaatattgaaaaacagccaaaaatatgctgaaaaccaccatggcacatgtatacctatgtaacaaacctgcacactctgcacttgtatcctggaacttaaagtaaaataaaaaatttttaaattaaaaaaatgaaactaaataaactgaaattttatggaaaaatacaaaaccccagactagacacaatcagcttctttttgtgggaaaatgaatttatatcaaagctttcataggggttctataaccacagaatgtagttagttccctgccaagtaaaacttagatacttccaaaatgctgctattgtacacaccgcaaaacagagcagccaaaatggtagtggtatgggttgggaagataaagaattaagaaaagtaaagaggaaggggagaggaaaaggagaatattatttccttgaatgatgatcactccttttattaataactttctgttcttattaaagagatgtcccaaacctctgggctttcccagaatttggtaccactggtgcactgacctatcctcatcctgccaatgtgaggaaacccagagagactagtcaaatgccctgcagagcagcaaccacgccagtggggctggctgtgaactttcactttggtgtgttctttgatttcatttggtgtgaaatattgagatttctcctcagatatcccagcgccttgtagctgcactggatctataaatctttatctgggctagattgaaccattttcatttatggagttgtttttaatcagagcaagagtaaaacttttgccctgtacaaaagagtcagctgtaaactgagccattctgcttcagctttcagcttctcctctgaagttgtgtctcttctgagagctctggaataaaacagctgccatagtcatctcacccttccatattttcctctttgtattagtcagctctgctatggtaactaacagtgccaggacctcagtggcttacagcaatgaacatttactttttgttcccacttttactaccaattggctgctgagctctgctccctctgtcttcccattccagagcccaagatgaaagataagccactatttgggacacactttttttttctgacaggatctcactctgttgccgagaggctgaagtgcaatggtgcgatctcagctcactgcagcctcaacctcctgggctcaagcgattctcccacctcagcctcccaagtagctgggactacaggtgtgcatgccaccatacctagctaattttttattttattttattttattttgtagagatggggtttttccatgttgcccaggccagtctcgaactactgggctcaagcagtccacctgccttaaccacccaaagtgctgagattataggcatgagccaccatgcccctccacactgtttttatgacagaagaaaaagaacaagagaaatgctagcagaaactccagatacttcttaaaacttctgctcagacacagcagacattatgtccactcacattcatcagccaaagcccttccatggtcaagcacaagatcaactagtcagggactcacacctttcctgcagaaggcactgcaagacacatagcaatgggtaggaagcaataaccctttttcatggaaagaaggatcaaatacttcagaataataattataacctaccataccctttaactccacccatgtaatttgtctccatcctggggagtttctcctgctgtcaacttaaaaggaatttaaaatgattttttttcttcttggaattcttctggggcaacatttgcccaattattcttcagaatgtcaccatccctcaagatgttaacagtggttgcacaatttaaaagaattccaccatcagataattttggcaaatgctacatattaatagcctcctcttaatatttacaattcttattaccatattaaatgctctgagaacccctgctgtaaagatacctatttaacgtgggattggaatcacagaattctttttgtaatggcacagccattaagactcacgaaattctataggcaaataccgtcccaaaggattacgcaggattcagtcagatagattcctgctgtttcctcatttctgtgcatccagactgaaggatacctaatgacgttgagaggagctatgcataaggccaatgggtctgtacaggcctcaaaaagaaggcttgcattttttgctaagaccaaactcaatgtcagaaacctgaaaatgttattcagatactactctttgtctactgaattaagtataaacacttcagactgtcttttgctccttcctttctttctgcaacaaacgtatcttgagtcctactaggtgccaagtactatgccaggcattgagtacacggtatgagcaaaacagacatgcaccctgccctgtggacttgccagtttaaaataagagagacagacagaagacagggatatgagtaaatagccagtgatcatacaacctcccagtggttagctacaccgttggccacccattcctccttgaaatgctttccacacttagcttctgagatgccactcttggctgattttcctcttcatcactggcttctccttctcagtcccccttgctggctcctcctccactacacagcttctaaatactaaagcagccagggtctatcttctctcctctatctctccctagatgatctcattcaccctcatagcattaatttcacatatgtgcccatgactcccaaatttatatctccagtgcaaaactctcctctgaggatataatcttcccccaattgaaccgccttagcacttcccactcttgagttatttcatgtgttttctcttttgccatgattgttttcatacttccttcatcctcttcctgacttataaacccctcgaggcggggatccttggtctgtttcatcttcagtttccgtagtgcattgcagagtaactgtttaatatatgattattgaatttaatgtttgaactgaatttctgctttagggatcactgagacacagatgtaatgaaagggaatattttatttaaagaaataatgcctcatccttctgtatttccaaatgaacaacctcaaatgagagaacacagctacagacattagcatgaggtgaatacttaagtttaaaaatgctaaatcaagccagtatcatcccttgtggtcacagcagctgctgctgcaaaggttttataaattgcctacattcccgcaccccatctggcgatgctggtgtgttacagccatggatgacttactcttcacaatagccttcacttggatctattccctactttaaaataaaaagacaaaaagaaggtgccaaagggcttgcctaaagtgctcccacccaacaagagtacaattcaaccacataatgctgcctcctcagcatttagaagattagattcagggccaaaggggaggtcagaagaggaaggccccctggattgcagcatttggtatgctgtccagctgagtccccagccatgttgtgagtcaatgcgaacacagcaggtttcaataaaggcaacagttatctaagcaggctgcagccgtgactctcagctcagcctctgggtcaccaatctgggacgtgagctggcacctcgttaaaaaaggtattctgacagagagatggctgtcagtggactcttccaaaaattctctttccctgggttcttctagtccatctccttggcatgtgccattccctatgcatcttttgttagactacatctctggtttctcaccacagcctggacactgctgatgggctagattgctaccatatgctttgtcatgcaccgtgatcccactcacaatgttattccagtgggatagatgctgagatggttcaccatgcaagaggaatcgtgctgcacgtagtattttctttgccctcctttggtaacttcgcaagttcccacagtcactactcagttatgcacgtgtgctaactcaggctcagactactttgcgattagagccctgccaattggatagcttgtatttctattcaataatcttttcattcactcatactaaacattcattccatagctcaatgttaagagccctttaacttgtcatatacatgatgactataacagcactcgcattctaagctaggctttaacacagcgctacagtggtgattatagaacagccactctgaactgcggcttctctagctgtggtgaatgttataaagaaagtgtatttactctagtccttgcccttttaccagtccccacacactaccaaactcaatataaaccccacataaccagcaagaatatctgaggtgtgcaggttatggcaatgggacagcagcagacgcacagtgggtgaggttcctgggacatgaccaggacactggtttatagtggcccaagctgctgtaagtctaagatcccactcaaatactgtactcactttcccacttgatggtttaggaactcttttctagcccccaaagctacattctgagccactttttttttaaacctacacagctgccttcccaaaagtatcctgcagtaattccatgttcctcctccattgtttcctcgttagctctgactccatgttctggcaatctttcagcctcattcctttttcctcccagtctgtaataaaactaagcaaaaggtagtaggtatattagctcaagaattgggatgtacctgtggaactgttgcgtgatgcaagtttttgtcaatgactatgggagcccctggcacggagggccgggcccaccacccctctcccaagggaaagaggacaagtccccatccatctgtcttctcccctcctctggcatcatagacccaccccagtagatagggtcatctcactgtctcccattggaggtggagtgggggagggtctcactcccagaaatgctcctacagctttctcctctcccttggattgaaggatgaaaggtagttatttgcttccccataggggatgaagcagggagtttccctagggttctgggagggcccacccttgtcaccaccctgtggtgccccaggggtaatcggccaactgaaggaatgtaagatctatataataaaatcttaattccacagaagtatgattccagccacaaaatttaagctctctgtagacactaaacactctacatttccataagtcccaccaccaaaggaggagaaaagagcatttatattctctctaacactgcgctatcccctcagcctactcccaaccaagaatcttgagcaaaattctttgctccacttcagaggaggaaagtgggaaatgttttttcctgtgtgcagagactactacaaagagggaggggctcctgttcgggcccatttaaactaattttccatctgctcccaatccaggtttttccagttttacctctttattgggatattgttgaatggaagcacataattaccattattttattttttataaatgggcttctacaaacaaaaacacaggattagtctattattagcatgaaaacctgtgccgtggcttctctgagttctacctggggaccagcacacccccactgtcttccagcgagcagaacaaatcaaagaggatttccagagacagcaataactttacattccacccactgctctccctggggcagcaaatcttcactgtgaaatctgcaattccaggagagcagaaagcaatctatctccctccaaaaacaagttgccatttcagggaactggacacattttcactcctaatggtaggtctccttggattactatggtctgccatgagcctgggaattgtaagacaaaaacagaggaaggaaggaaggaaggaaggaaggaaggaagggagggagggagggagggagggagggagggagggagggagggagggagggagggaaaaagaatgcaaagttgaaatatagcaagaacccattactctatgagtccagtgcgctacaggctgggttccatctcacacacacacacagtgatgtcccaatgtaaggaatcccagctagtgggctccccaactgaattctacctctcagaagggagctggataggacaaaatttctatctgaaaggtcagagcaggattaggaggagaaaccaagaacacagacttagcccatttcaactagcacagaaggacccagaatgccaggtatgatagcacctaacaaatatttactaagcacccactaagtgcccagcactgttgaaagagatcaagggaacagggagatggttggtgctgacgtaagtttgtaagaagtgagcaatcaccaggcagcaaaggtgttgggggtccgcgctggtcatagagaaaggacaaggagcagaagactggccgatcccaatgccacagcaggccctatggtcacaggtgacacctcttccttgtcccctcagtacaacagtgtataagcctttactgtcctacaattcttctttttgttacacagtggctttcaaccctggctgcacatcagaattatctaaggaagttattaaaatcctgttgcccaaaacccaccccagactaatgaaatcagactccgtgggggtggcacctaggcttcagtagttcttaaaactcccccggtggtcccagtgtggggccaagattgaaaaccattgcatggaggtaattgtcctaattacctctccagcttttctctgcctctacattcctcttatctaagctgttatattgcctttttatttttagtttgttctactttgtcctttcagtagataattctataatactccattaaaccttttttcatgctttaactttgttttttctcatttaattttcatcgcccactctacttactccctcttcccattatgtttgttttgttttgtgttttctttaattcagcatcaacatttgcagggcacttgatatggacagagtacggcagcaggcatttaactgctgctaaaaattatatttaacgcagtaatattttgtgttagatcctgtgccgtggctacaggctcttgtcttatggaagattggcactttggcttcttccttggaagtagctgcattgctgtataaatttaagatccaaaataagtatattacaataaaaaataaaagaagcatccacaaatatgagggaaagaagcattaacagcagtctgaagctaaatatcaacatcacccctgccaagctcttggcctcattgtaggtggaagacgctgccatgtgcaacaaaaagagaaagggcccaggctgcatgcacaactaacgaggctgttccctgaggaaagggcatttgctgatttagactcatttcctcaaggtcctcaagcaagcccaagagtacataggccagtcgctgagacactgaaagttgagatgtggaagaaagggccaacagactgtcccagaagcagaatgcttcagtcctccagggaagctttgggggagatctgccctcgtgtcctcctacagctcagctgagagcagccctggagcctcagaaccacaggccctgtagttccctgggtctggcaaacccctgggagaacaaatcactgtcctccccacagagccagcccagcactgagaacaccatacaagccagaggatgcttgccaaatagatgcatgaacgaacgaatgaatgaatgaatgactcctctgatgaagttgtcccagggagagtttgtgggaatactgaaaaggagggtggtccccaagctggtaccccagtccttgatactctgatgtggctttttaatttctctgtcttccttttaccttgatgtatttattctctatcaatctatttgtttatttatttatttactttaggaatcaagccagacaccttgttggagcaacaagagctagagatatttgttccttttagaagaagcaaaattttccagtgccaactgacagggaagaagatgaataattacactatgtcctggtaaagaggacccgagacggcttcctgattttcgtacatcaacaaggagacgtctatgaccctggtctccagcacacctttcttggtagagttgagaattcaaccagccagttcttcctggagattctcagagccacattgagagagcagaggacttacaagtgctgccctatccatggtgactccccttggcctctaggtaagtcacacactgaagcctgcccctcccaccttccaccctggtcagctaatctaggttagtgcaggtctaacctagattacaaggcgtgctcgtgtgcataatttcatgaccaccaacaaccacatggggcaacgttatccccattttattgtccaggaaaccgaggcctggtgtggtaagtgacttgcaagtaagaggaggagtgagatataaacccagattcctgaatctaaattcagtggtctgtactgcagcatagctgccgcctcttgagaactagagtgggcagtgtggaagtgggaattcccaagttcccaggcctcttccagctcagtcttctatgtaaaatttttcttttccaggcttgtctgagcagaggtagagtgaccctgccgcctgttcctcaacagtctgtgcaaattcaaagaaatagagtgtgaattcaaggaactcatttgaagaacaggaaaagcaactctctccttgaggttatcggggaaatgaaggttgaaacatggatcagaagacttgctgaggtcccttccaccctcagctcttccattctgttcccaaatgaggcccaaaacacagctttctccatcactctttaatctgttggttgatttgtctggtgcacccaaccagcactgtggccctgaaaataaaatgttaattacatcaatcttacagccatccatcgctagccatctgatgctgatagaaaggcaggaagcactcgtggcagtttgcatatcagggtcagcagttcctttcttaaccctcctctgtctggcaaggctaagggagcagacgttcctgtaatgacctggcctgtctttagagctgcagccctaagagctggttttcttcctgtggctatggtcttggcactgagctccttcctgctcttcttttgctcttgtgtgtagcggaccacaacatgctttcagatcagacatcctgtgggcagaagaaattatttcacttcaataagaatttttgaagaccagtatgggttcaacgggtgcttttgggagattacaccagagataagaacagactaaatcacacgcgtgaggcagcatttacaaatcatacaacacaatatgcaatagcagcttctgagtttctgcagaggaaaggctaaggacagcaacctggttggaagatgcctcaggaacttgccttgaggctgtattttcatagcacataagattgggaaagacatcaaagaatgggaaaccttccattctggagagatggagattatgggggagaatggataaagcccccaaaaacactcttgcctctcctactaactgttcaagtctcaggtatcattatttgtatgacaaagagaaaattaacatcgttaagcaatgagccaagtgtttacaagtataatttcatttatttctcacagaaatcctatgagttatcttctcccattttacggagtataaaaaaattagttttttctagaaatcacatgaagggacagacatccccttggcaggaccaaggaagctgtggcctaattgctggccttgacacgaaggaatgactgagcacaaagaacacagcctacacagggccggaggagggttgggtctgagggcagagccctggtggatgtttctgccttccacctgggcaccctgagacaggctgtgtttttgttgaagttccatcttgtcctgccacaggcccaggccaagctgactgctcctgacctggtgaagcactagccacactctgccccaagctcccgccgcatcatcacctgtcctctcctgtactgtcttctacctctggctttgatttattgttcataccagctttctctcttagtcaggcctagaggaaggttgtttttggccattagcaataaattcttaaaattccctctaaccggtggaagatataaatcacagtcataaacataatacacattcttgggacttttcaaaatgacttcctgaataatttgagatagttcaacaataattttctagaaagacaggcttatttgagccctgctaactactcttttgatattaatacagctttaaaccctctatacttctttctgcctcaaggcttttttaatacatgtcctcatttgttacatagaatgttatttccccacccatgccccatacctgtttcaggcagggtccaagcaggagacagggcactctcggagtgattagagagagtttaatgaaagggacttttacaaagctgtggacaggtgttatggattgaaatgtgtcccccaagggacacattaactctcagtaccttagaatgtgatcttatttggaaatagggtcactgcagatgtagttaccttaaatgagttcatactggagtatggtgggcccctaatgcaatatgactggcattctatatgacagccaagtgaagacaaagacacgcagggagagaaaaccatgagacagtgcaggcggagactggagtgatacaggtgcgagccaagccaaagaccatcagagtttccagcaaaccaccaaaatctaggaagaggtgaggaaggattcccctacaggtttcagagggtgcatggccctgctgacaccttgatttcaaactttcagcttccagaactgtgaaacaatacgtttatattgttttaactacccagtttgtggtactttgttaaggcagctacaggaaattaatacagaagggttatgggaaaccaaaaagaaggtggtgaaacacccagggctggcaacaaagaaccgctgccatgccaggcctgaagcgtgtaggggaggagcctttactgaaacctgcagctgtggaagaggagttatagcttccagtgaaggaaggcactctcctccttccctccagtctcctgaaggtgtctccattggccaaaccaaatgggatggagagccggtggatgctgccaattaaggtcaggctcagagtaagaagtagagtggatgtgcagaggcaaacagactcagtctcaactgcaatgccacttcctcttcagggaagccttccctgacctcctgaccaaacctggcctctgtaacatgctcccatagtccttctgcttctgcagaatatttatagctgcaatggagggataaattatgcaaattattaagtgatgactggctctcatgctagaacataagctccatgaaagaaaacactgtgtctgccattcatcaatggcagaccctgaatcctcagggcctggcatatagtaagaatgactaggttttataggatgtgccaagaactaagcagcctgatagaaaaaggtcaagtatttaagtccaaacagattgaccttggcaactttcaaagagctatagacagcagacagcattatgttctgctgggggacagggttgctgatgatataatgtgtaacatcaaagaatgtgaccaccttgaatacttgctaatagtcctccaagagcagtaggcaggatgggcagttgtgcaaagtgaggcgaggcagaggtgggtggggagagcaactactatggggtcaagaaacttcatctgctcctatctgaatttttttcagggcagtctgttcccagtcacactggggaacttaagaaagcttagatgagtctttcctccactaacctgggaatgtaagtcctgcatccaccctccaatatggaagccacctttgctcttgcctttttgcttaccaggtgactctcttcccagcttctgctgcactctctagttctcattattaatttacctgtttgatttcaaaatttcaaagattgacctttaaactcaaaagtggaggtcccaaaaatcctaacctcccctcttttgaagtccatgtaaatttagcccgtcataagttgagatgtagtggtggtttctaagttttttacaatgtttggctttgtgtaatttaacacaggtaacctaagaacccttcagaaaagaagctagatgagctcaataaagatcaggaaactctggctcacatttggaagaccatgtttcattggattgctctttaacacatgggtaaatcacccttatccaactttgcctagagggagtttgcagtgaacacaacaatcattacaacatcttcagtctttgtgcacatgctgttgatctcctcatttggtggttcttttgattacagctgtaaatgccaataattcttcttggtatgaactatgaacatcaccacatagtgtctaacatgtacatctaacctgaaactggaacaacaatatcaaatttaacgtctagggaaggaagcagaaaccctgtcaccaattaaataagctgccttaatctcctctcagttggcctaacttacctgaaccgtactattggtcttgaaggtggcactgtcatcccattagcaggcagcaggccctgcgagcctcctgtgatcagctagatttctctggggaatgaaacagctgctgatagggactgacttcctcagtcacaagtgtttcacaagtgtgttggttcagaggagggaccaggcagaaggtggttgagaggcagagctgcccctgagtgagccatgcagaggatctcctccctcatccatctctctctcttctgggcaggtaaggcagaccccagaacttgggccaagcaagactcagcagcaaagaaacatcaaggctcacaggaccttgtactcatggactgtgctccttactcaatgacctcagcccccagccctcactgagcccctctcttgtgtcttttctctcaggagtcatgtcagccattgagttggtgcctgaacaccaaacagtgcctgtgtcaataggggtccctgccaccctcaggtgctccatgaaaggagaagcgatcggtaactactatatcaactggtacaggaagacccaaggtaacacaatgactttcatataccgagaaaaggacatctatggccctggtttcaaagacaatttccaaggtgacattgatattgcaaagaacctggctgtacttaagatacttgcaccatcagagagagatgaagggtcttactactgtgcctgtgacacccaccctgctgcagctctacttctgagcagctcaaaaaccactgaccaggcgcggtggctcacacctgtaatcccagcactttgggaggccgaggtgggtggatcacgaggtcaggagatcgagaccatcctggctaatacggtgaaaccccgtccctactaaaaatacaaaaaaaaaaaattagctggtcgtggtggcgggcacctgcagtccgagctactcaggaggctgaggcaggagaatagcgtgaacatgggaggcggagcttgcagtgagccgaggtcatgccactgcactccagcctgggagacagagcaagagtccatctcaaaaaaaaaaaaaaaagaacattgccatccatgtagagcagcaattccaacaagatcgtgattttctcttgaataaataatttaggaaatagggaccagagaaagctagtgtttctacctttctttcaggctcagccactcagcttgcccgtgccctcccatggtgctcagataggcagcccccagtgggacagaagagaggagagatggagccaaaggaatgaactgtagcatctactgtgacagttttcttggaggctcataaaaggtatgaccacagagccacagtgcttagagtatagcatagattaaggaggcaccttacaatttacaactatgggtgacatccagtttttccccagccacatgcctctgaatttacatgttctagaggaaaaggactggcagtggggggaggctcctctccctccttcagatcaaatatgtacactacctgtcattttgcccaacatggaaggaaaggctacatctctagcatctctagcatgctctgttgttttgatgattactgactggatattttgttttgctttgttttgttttcttcatgagacggggtcttgctgtgtcccccaggctagagtgcagtggcgtgatcatagctcactgcagcctcacactcctgggcccaagctggatatggtgttttgctctccctttcttctctatctctttacttccacatgtgctagaaacaaaacgttgaaaaattgcttccactggcacttccttatccttctttggacagctcaatttaacactgcacttttatcttgaacaatgtgtttttccagatttagatgattgacggggctctctactccaaggctgaacctgtggcagaaatcagccttccttctgtcctcatctagaaaatctaccacttaccttgttaaataacctcataagaacttgtggtgatagacatggtcagtgacttgattgcggtgatagtttcacagatgtacaggcatatcaaactcatcagattagacactctaaatgtgtacagtttatttcacatcaagtatacctcaatacacttgtaaaaatatttgtttaaacccaaaatggattttttaggcttctttggactacttcaggcaacgtctacacaaaatgttcttcaacaaacccctctagtcaaatatcctctagtcaaatatcttccacagaagtacaaagaggctgacagggcttgccacaccttatttggtttcagtcagggcttttcactgttttgccaagtgtcttcccaatcctctctcctctcatgattctgcctgacctttcatatatataatacatgttatatatatatgttataatgtgtcgttgttccatgcattttagtcatgactgcccccatgagctcttatcatttatctccccaaatagctatattctaaaccttcagaaaatctctcttctctactcttcatcccaaactcactcactttgacctgatgcatgatcccaacataggcctggaacctgccttctacctttctgccccaccccattgggcaacttctttggttgaacggtctgcaaggccctggatactggctctgcccttggacaaaatcgggttcccaaatccccatccagatacagcactctgagctccacgatcttggaaggggtttggacccagccttccccagatgtatttaaacagagggcctgtcatgattcatcaagcccactgcctgccactcagatctaattctccttctttgaacaaatgataggcaagaaggtggagtgcatctccaacatggagaggatacaattattctcctagtttgaaatcatgatttggaaaaagaatgacatctggaaaactggttatgcagatgtcaaagttgtggagccatggttttataacgcctgcaagatggattcctagtaagaccccaagtgactccctctaacagagactgggaagagtgtctctaaggagaaggaggggaaaaaatatctggacaaatccataagactgtatgtcttccgtattaataactaatatctgttgagtgcttactatgtgccaggcagcattctaagcacttaacgtgtgttatatgattaatcttcacaacaaccttagtatttactttctattcttgtcctcattttacaaatgagaaccccaaggcacagaaaacctaaaatacttgcccaaagtagcatagctagtaagggagggtgacagatttcagactcttgatgctgcaccagaggacacagcatgtaatttggggagatgggggacccatagagaaagccaccttcaggatgtgtcagaaccaagggacaacaggggctgtgccctcaccaccaaacctgttccaattgatactcccgtgaccatctgtcaaaaaactgggacaacagaacaatggtcccaaatgacctctcaagtgttttctaactgagattttgtgatcctgacacaagcttcacactgtcttctaaaatcatctgcatctcttcatctgtgaaatggggataataagagttctaccttcactgtgttataaaatatataattatagaaagtaaataaattgcatagcttatagtagctatttaataaatgttacctattataagaaaaagcaaactgcaaggaagaataattgagaagaaagtgaactaaattactgagcaccaacgaaatgcagccactttacaggtatggactcacttatcctatgacaactcagtgaggtcattatcatcctttctgttttgcaagtgaggatactgagactcagacaggctggacagcttgcttacagaagcagagccaggatccggatctgacttgaagcctgattgtcctggctgggatactgggctgggagctgcggaatgtcctaaagaaataccttacctatagcaacatctcatgtaaaggatggctgggaacaggtatgtgaagtctggtcatctttgctcatgcaaagattgctcttgactccttggccagtttccagaagaagggatagtaggaggtcttcaactccttccccctgcctcctctcccctgctttaaaacaccaattgtaatttcagcttccaggttgttctcccgagatggctcactcccctgactgaaggaagacagctactccccagcccactgccactcacactcctgagcaccacccctaggtcagcagcttttctcccagggtacaccatgagaaacatgagagactggcccacatattccctccttctgatgcttgtcaaaggtagtctcttgttggactcccttagatcctcggggtgctcatggattcactgccttttcctctccttttcaggggcttgcctggagcgaaaaccataggggtccaaggccggcataatgagagctagaaaaattccctgggtttctgtcaggtccatagagttggtgactttaccacccacatatatctttgctgtcaagcaaagtgtgcaagtttgtctcttccgttgtcatcgacttatcacttatacagaggcagcaatggggcttgagatctgacaaccacaattctctgcattcaaaagtgagcacacgggtaccagaaaacactgcggtggatgaaggtgcaggagccaccgtgtaaagaatagaaattaatttctaactaaatgtctctgctttagttagggtcttagtccactgcagtatcttaaacaatacatattcaatgataaattttccataatgacaaggtgaacaaactcagaatcaaagctcctttcctactcttcaattcaacacattaccctaaaatattaattgaaatgataggattatacagcttttttttttgtcagagcactttattcattctttcagtaaataccatctctcatatctgcttaatttttctccacagcatttatcactatttggcatgctacatattttacttgtttatattttgttgtctggctctccactggaatacaaggtccttgatggcagagatgagtttttgtctgttttgttcactgctttaactccagcacttagaataactttggcccataacagacactcaataaatgtattaaatgaatgagggaatgaaatacatatgagtgagtgctacgtaccctgcactgagctggatgccagggacacagtggtgcacaaggctggtgcggactctgccttctgagatgttctccccaagcctcatctacccactaaaaaaatgctactgaccgtaacaagattttctgaagagttgattatagagtactctggaacaccaaataacttactcttggagagcagacatcgaggctcctaagtgcattggatgttagcaggggcaaaatgaagaaaatagtagctttctcttttctccaccttttctctcttttgagtcccaagggtcccagccctgagtctgaggctgtcaaagaaaaagcgaaacacttctgttttatttcacaaaggaatttcgcaacgcttctctccaaacagactggctggggcatgctatttcacaatgaaaagccacgataacacagtttcctaaacaaaggggcgattcctaactccctctcactttatcaccactgccaccaaatgattttggtattcttcaagaatacagaatccactgggtctttttgggctttttagcaatttacacatccacaaacacataggtttatgagcggtaacagcgtacattccagtgcatgaaacactgcagggattctctgaaggcgtgccctggatgctgcaaggctccaaggcaacagtcagccagtggaacagtgtgccacccagcatgctcgacttgatagaaaaaagacccagtgacagggcaaaggaagtcaagccaacatgcaattgcttgtattaatttaaataaagccaggttctcaaactccatgtttaaataagaaatctaacagtcataagttttctttttacctgcatgcatatgggagaatagggaaagtttaaattatctttctggcttaaggacaaaattgcatgagtatttataactttcagaaaagaaatgtcagtctaaatatattactagggcaacaaattattaagaaaaaaaacccaaagtacagtcttttggaaattaaagttgctttcatagaatatagcagcattcactcagtaacaattcattaagtacctcatatgtgccagacgcttttctagacacaatggaagcacagctctcagaatctcaggagcttatatttcagtggaaataaacacaaaataaaataagtaaaatatatgtcagatggagataattgccatggagaggagtaaaacaggcggggagagagagagtgttgtcagcaggcttgcagaaattacaattttaaatcaggttgtcaagaagggatacaataagaaggtgacatttcagcaaaggcctgcgtgtaggcagggagcccagtatttggagtgtggatgtttgctggactccctctgttagaaataacattttcatgcacattcttaagacataatcataccagcttttctgtaggttagggagataaggagtcattttttctttcttatcttgctaagagctctttcacaagtagttcacactttcatttttcaaaatcaagcgatgaaatgccattaattagcacaaagtgtgttggggagtggacgcgagggtttggcaaggaagcagtcctgaaaagatcaaaacttacaacatgaacaggaagatgacagcactgattattgacaaacggaaaatggggcatggcattttgagccctttgccttgagtctctccctagtcacgtgaccacattctgtggactggtgagtgtttcttccccaaccacagggataagaatacaaagtgagtgatgcatttctctcactggtccccagatgactccactctagcagccccggaaaagaacctgcagcctcatctatacctgcaggttgatgtgcctcccaaaaactgtctcactcagttgtggagctgaaatcaatcatgtgttcacctcagtggggttcttggtttttcttttctggcttctccaaaaagccaatcatagagaaacctgaggactgtggagccactatggagaaggctggagtgcctttaccatccctagctcagctttagggattcaccctccaggacctctgagtgtgctgggatcacacggcctaaggtaggccctagagtcagtttctgtctttacctgccacctgacaggagtgagaagttttacttagaggcagtgagaagggaagtcagcagccccagggacagtacaaaggagacacagcctgagtgtgtgttgtcagaagctctgtcacagcgaaggcctcctcgggcataaagacctcactgtgtttgcataacacctgtgttataatcgtgagtgatcaataaaggattaactgcctcagtcatctaaggaaatgaagaagggttttatgcaccaagttcataaataaggacacagaaaaaaaccacgaaggccagtgtagctgcctctgtacgttgaaattagagaactggtacaataacaataacccacctctgtagtaagaatcaatgtaaaatctttgagttcatagctagtccatttctcagcatcaaaaccatcattttgctttctgtatggaggacgtccacccccacatatgcacactcagagtgtcagagcaatgagaaaccaattaccatcaggctccacctctttggttgaagacatagaaactgatgaatgaagaaattaagtgacttttccaacatcacacatatagtgcagacaggtaaagtgatatactgtacttctgtctctttcctccaatatcctagaagtcaagggctaagaaaagacagaaagggtaaaccatgtgatcatgccaaagtgaaagaaaaatggcagcggagtgttctccacattccagacaactacctcctgccaccttctaggtggcaatgcagtccaggtaggtaaagcgatatacaaaaataaatagccttaatcattcacaaaaatattaatgtgtgtcaaatttaaaaacaatgaattgcaaattgcccctaactttggcaagatcctttcacctaccttaaaatggacaagtttacaaatttgggctataaactgcatataagtttttgttggttttttttcttccttgagacggagtatcactcttgttgcccaggctggagtgcaatggcacaatctcagctcactgcaacctctgcctcccaggttcaagtgattctcctgcctcagcctcccgagtagctgggattacaggcaggcacaaccacgctcagctattttttgtatttttagtagagacgaggtttcaccacgttggccaggctggtctcgaactcctgacctcaggtgatccacctgccttggccttccaaagtgctacgattacagatgtgagccaccatgcccggacacatatgagtttttataagtaagttcttttagtagtgaaaaaagcataggctctggaatcagagaaaaatagaatcacaacccctcacttcatagttctgtgaccttgaaaaatgttgctttaacttttctaaccctctattccctcatccacaaaataaggataataattgcatagagttatcataatgatcaaattaaataattgcaagtaagtacctgagtgactacaaagcagaggtgctcaataatactaactccattcctttcagcacccgatggtctgcagtagagcggtttcaccctctactccagacagaaggagacagaaaagacagaaaagctagaatgggagagaacatggccaatgaccaccagcatttttccaaaccaagaaatctaaagtgcctatcagcacattttttataaaaatacctcctcaggaatgttcttcccacacaacctctctaaatcctttccctgcactaatgatagtgaaggtcccaaaggcaagaccatcactgggagggtctagctccccaacaagagatgatgccctcattgcccttcatttgcagagatgaaggtgacacaggtcaatgtcagcttcaccaatagtaacagggagagtaattttttttttttgagaccgggtctcgctctattgcccaggtcggagtgcagaggcatgaccatggctcattgcagcctcaacctcccgggctgaagtgatcctctcgcctcagcctcctaagtagctgggactacaggtgtgcagcaccatgcctgggtcattttttaattttttgtagagacaaggtcttcctatattactcaggctggtcttaaattcttgagctcaagtgatgcccctgcctcggccccccagagtgccaggattacaggcatgagacctcacgccctgcatgaatgaattttttacatcaaaccttctccaacaaacttggttcagatgtctgagacaagagttgcacaaaggagtctcagtcttcagaaagttcatccttacccagctttatggatgctctaggacacatttaattcttgcatccatttaggaacagagatcttctcccatccttaaaagggaaactataatattaattactgacctgtgatgagtcagctgtccatcctcatttggcccatgctgtctacatgaagttagttttcactgtagtgcttggccaagaaaaaccaagtttttctaaatgaattccaaggataaatagcctaattcctgttctttggcttcttccactaaagaattatagggacctgatctagggaaactggggggaaaagccagggaatgagagccactgtcttgccagaaatgcatgttctgatgaggaaagatagttcaggatatctgcgccaaatcacacattggaaagaagctttctgagatctgaggaaacttccacctgctaaaaagagctagcagtctgctggaaagaaaaaaattcattcaggtgtcagaactcttactcttcactttgtgtgtgactgtagacaagtcagttaacctctttgcacctcagattctcatctgtacagtaaagagttcacattagattgtctctaagtttccttcagcactaacaagccgtgggacataggagaacaaatttgaaagattcctgagatacaggagtatggattcctgcagctgattcctttatgtgacccagtaaggataaaatcgaaaaaaggaactaaacgaaatacactcttgattaatcaaaggggattgaaagtcgtggctaacctcacacctaccttgcatcacctccagctcacctcccttgagacactcctcctcttctttaatgcctcatcatgattctcaaaaactgtgatcactcaaggttgaagcttttaatctcccatgtataaaaggatatgcaaatagagttcagtttcctgttgagtctctgccaaggtcttagcctggcagttctgggaaaagagccaaagacctcatatttcttggctgttaacattctcccatctgtgctcaagtcagcagcctaggcttcaggctgtggtttgtctttagtcttacactttcccaagttttctgaaggaaccctttagaatgttcctgcaagaaagtaagatacaagtggctcccaagaaaccagacagaggattatctggttatatttggaggcagtaagaaaaagaccaggaagtctatattcctatagtatatagccacagaatccaatcttgcaagctacttgaaatgctgatattaattaagtcttaggcagggctttcaataagtcatctgtgtctccaatatgggatgtcccacatcatgcatatgcacagtgaaaaaaagcgaggtccttgggtacagtacagcattcaaaaattaaagatctgaaaaacacaagacatctcagtgtgcttccgggctggaggctctgctaaacaacagaagcagagaccggactaattgtcccccatgtctctttgactgaactcacacaaaatagaatctaccatttttactcagtgcggggtacccagactcaagtttactgcaatgttgttaccaatattctaatggaaaattatatattcagagctatgttaaatttgaccatttattaaacatgaaatttctactttttctgtaagtgccttgtcttacttgtatttcccggtatttcccttctaaagctaactccccaaagggctttcctgtatgttctcacttccattacaaagtcaatgtacaagttaatttttttaatttctttagaaacctttataaagagatttcctccttcatttctctgttatcccaggcagctgtcaggagcaaagagctcaagcctgcactgccttggaacaggacatcagcaaaagacactctcaatctactcagaaggctgaggtgggaggattgcttgagccaggggttcaagaccagcctggacaactaagtgaggctcagtctcaaaaaaaaaaaaaaaagatctcaatattattgttccatacccagtcattcacttggtgttttctgcagcatttatttataaatatctcagtctgttcttaatccttgagcctatattttttaaaatcatactttgatatctactcagagtattgattctcttcaaatttcccacctcttagttctcctcccactctctcccaccctgagccttacacctccaacaatgatcattctaagaccatttatatctcaataggaaagtgatgtaaaacgggtctccttactctgttttggagggtttttttgttgttgctgttgcttgcttctctgtcccaccccaaactcatgtgtgtctgaaatttagcaccaccttgcgacgtttgtgagcatttttctcagagcagcattttgagactgagcctgaactccactgatgttatgacccttaaaagtgtctggctccaaaagactaaggagttcctgcgtaaatccaggtccagctacttcatcactgtgacttgttattggaaaaggttgagctatcaacatattgctcctgtaaaggctcagaactgaatcttagattcttcaggatatttgagtcctctgaggctcctgggtaaagactccaatgtagcagttctgtggactataaatgggagatatccagatcatacaccttcaatggaagaaaaagcactgtcaccttagacgactccaactctgtagtctacttttgtcttcctaatatcatacctcattctccagtgggtttatggcaagcctcatctactcagaagtaaccaagtacaagccaacacactcttgtgttagtgtggaggcccaaagtggcataagtgaatgtgactccagatgaaaaccttcccctctccaacacaaagatgccaaagactatgtataaagcaagtcttaaatcactctatatttccatttgaatatatttccccagttcctgtgcattgcttctgcatacacagaattcaatgataaaaattgagactgtctcctagatacagtaattaactcagctatcaatgccaattgactgtgtagaggggagacaattttgtaccaagatttactaacctctattttaatggaaaaacaatggaaaagctttcttcctactatgactctctctggataaattgcttgccaggaagcgttaggataattctgccatgactctttgtcttccacacccaaagacatttggtctccatcacatatggaggaaggatctccttgttcagcagtatttacaccatcaccctgacacccgcagtcagatctaactatacagcttggctaataaacctggagaagctcatattctaagaaaaaagtggagagtggtgggacagatggggcctgagtgctgggaaactgcccgtgcccactgctgacttggtcttctcaccagctgcttgatctaacagatgcatcttccttatgaggcaccagagaaccagaatgtccacatcctgtggtcccctgtacccttaacaccccacatttgagttcctttccaattcagaaaacaaaacctgcaggctttgagccaatttacaacagatgtgggtcacaacaaccaactacccaggaagcctccaccagaacgcagcgtgagaatcagcttcttagatattcccatacgtgtgatcccatcaatcatttaacaactgtcaaagagaaagactaggagactttctcccgagcatctccagggatttaattcactatgttggaaattaagagattactactaagccataagaaggctaagacagagttaaaagaattattggaaggttggcattacaactttacgtgtacactaggaaaatctgcagctctacctgtagctttgacataatgccttcctataccctgtccttgcccaactgtgactcccacatcatggtcataccctggataggcccctctctgcatgtagagcaatgtgaatggggattctgcttatcaggatatcatcactagtctgtgccaggccttgcaagaatgtccttgtactgcaactatttgtaccagatggtaccctggccacccctaagtgtgcagactttttaactttttcccccaagaaagtggtccctgatgtgcactgcctactgagtaaggctaagaaagataggaaggaagaggacaaagtgcaaggagagaaacatttttgcaaggagaaaaataatgatgtggatgcagaatatttatcatgtgaattcatattaacctgacttcctcagaaaatgtcaccgttagtattagaatgtgtatttccttcggagctctgaaagaaaatatgagaattcaaggggtgctagtgcagaatacacacacacacacacacacacacacacacacacacactgtgcttcactgtggctggaatgatgcagagtcttggcaatagttcgggaagctgctagctgtccgcccattgtaaacagtgaagtaggtcatctgtggctccccatcctcatctgtctgggccattttcttgggccctcctccacatcccattcctcatatgttctcattctatttccatcaaacctcaatctcaagaaatgacctgaaatcaattcgtactaatgtttgagtcatgaaaacagaggaaggctttagcttctctgagattggcagggagggtcgctagtgagcattgtattttcataaagataatagccataagctaaacactgcagcaaccacagcagaattttccaagcctgaggaacactgcccaaaatgaaagacagaggtttgttctctctttgtttggaggttcagtgtggatcatacacagagagtctggagcctcccacagtggacacttcttttcctctgtccagggagaagtccagctggagcagacaaccagagagaacattagcctgaccatggggaaaggcattgcagcagaattaggcccaatagaggaaaaaagatgcctggaaagaaatttcatttcaatagcaggaatagctttgtaagagctgatagccattcaacagtgaaacaagcatccttgtcagtggatgagttcggtggatgactacactgggaaggttgtctacattggttgggagctaaactcagtgagctctttccctcctagaattcattatatactgtatgtatatgattatatatactctgtgtatgtaatcgtgtattacatatactccatatatgtatattacatatacatatattacatatactctgtatatgtaatcatactccatatacacatttgtatccattacatattcaattttccatgctattggatatttttcctattcaataattttaataagctatgttaatattgtatctagagctacattatagtttactcaatcagttctcttcatggttgagcatttaggcaacttctaaatttttcctactatgaaaattattatgatgaacacacctgtacttacaactttttcattatttaaagtcatcatatatgtatatgatgatttggatccacttccacatcccattccttatatgccctcattctatttccatcacaactcaatctcaagaatatttcagtatgtgacctgaaatcaatgcattctaaagtttaagtaatgaaaacggaggaagactttagcttttctgaggttggcagggagggtcacaggtgagcattgtattttaatagcaataatagccataagctaaacactgcagcaaccacagcagatatacaaatggtatatatacaaatatacaattatatttgtataaatatatataaacatataataaagtaagctcctattttcttaattagaagattcaaagttaagaattttgtccaacttgaatatatgaaactttagggttatagagaaattagccaattctactttagatgttttaatgtattaatacagttaaacacacatattttaaaattacatattatataaaataatatatcaattttgaatactgctatttccttttaataattcataaaataactttaaattcttcacaggcatttcaaatcaatgtatttgttgccactagagccacttttttatcctcaaatatttttccagagtatatgaaactcactttgctaaattgaaaattaagaggcacattagatttagaaacataattttaaattgtttcaatgatggcacattattaatacctactttgagacacaatacatactcacataatattagaatcattgttttgccatttatcctgtaagtgaatattcatgatctccacaacaaaacatttactttgatagatttgtttaaacaatatcaaacacttgcagtcttgaaggcactggaagacccaaaaaatagttactacgtttctgttaaactacttagtcatctttttaactaattctatcagctgactgccataagcatccatgagctagcattgattgagatcattccaatgtgtcctcactaaactgtacttaactgttcaaagccaaataattaagtgaaagtatggtaatactgtttttcataattattgtaaggaatcaaatataagggatttcttcttctctgaggatcatgaaccttactccatgttcaaatagatatagtattttttcacagtaaattccccaaagtggaaatagtcactcaaacgaatacttttactcttttgacattaaccaaatggcttccaataaaaatcaaacaatttatatttttaccaacatcttgcccacattgggagtgtcaacattttgagcaaaagctttaattaaatatccatgcaaaaaatggtttgttaatactttacagttttattactagagggttaaaatcctttttcaagtctgataatcaatgattaactttcttcatttgtccttcacccatttgttttttaggttgatggtgttttacttattgatttgtgtaattataataattttgtgtctgagttttacagcatttaaccacaaaaacagcattggtgaaaggagtttcaggggtattgtggatggcagcgggtggtgatggcaaagtgccaaggaaagggaaaaaggaagaagagggtttttatactgatgtgtttcattgtgccttcctaccacacaggttggagtgcattaagcctttgtccaaaaacacccagccgtgacccgctatgtatgtctcagcattgggaagagtcctctgagtgtcatgggaaaataatatatgagttttattgcccctgtgtcccaattattttctgtttactccatgttggtctacagcaatagcttcagaacataaacaaatatcaccaaaaacatcagtgatgaacaattccaaccacacatttcaatgtttactaaatatacccgtggcactgtaaaaaagaatataatggaagagtaaaggaattgggactgatcgtgactgagaacctgtatagtaggctacacactagctatatgatgaaccaagaagttgaacccaaatctaactaacttacataatcccttcctttaaagaacttaatgtccagtgcaaagcaagtgttcaaaaaagtgtttgttgtgaattgaattcatttcattggaatacagcatgcttgcaaagtcccaactttttaaaataatgtgtttctaaagaccactggtctttagaaagaccaatgaccaaagaccttagaccattggtctaaggaccatctggaagcagatccccaaggtgaaattctgacgttgaattcccaaatctaacaggtcatgtgccttgttctgatgagaaaactgtcgaataagggagtagcagtggcatgaaggttgttagtaggtagcataggccaaatggcccagtgatgtgatgaaaagtgcactcctccaaataagaccctagttactagaaagtcacaagtaggtaaacagatgccgggagggacagtttttgttggataaagtcagcagagaaaggcttttggaggagatgaatcctgagctggtgtctacagatagtgacagacttagtgcgactaggaatattatggagaataaaagaatctccctctctaactaatgccaccaagcagtcccttcaccccagagcaaaggcataacctatcttcacccaagtgaactatgtattcttgaaatatatctccttggaactaaaccatttttctgttcacttcaaatcaaccagtgttaatatcatagatctgacagcttagaaggcctgtgttctccttcactcttctcttgaccctatgtgagtttgattcaagagcatggggattagtcccttctcttgaattacaatcaccaatcagcacaccacatccagttgctctttttaagtctaggagagcaaaaacaatgcacaggtgaaggaaactatgcctaggcctcatccctaggttgtacaaagtaactgaatttatggcttcaaggacagaataaatcaaataaaatcaaagaagcccattttcagggaatagaaacaattcacagaaataacaccttgaatgaaattctcatttttagtgcagaaatggaacataacattcttagattacttgctttctaaaagtgaatattctttaggtattactttttcaacattgatgagtttacaacatttctttttgcatagcagacaaaactgtgtaggcattcacagttacagaaagaaaaaatatgactagcttcctgcttcacacaaagaaatcatgcaaaaaaaaaatttcaagccaaaagaaaaaaaaagttttaaaacattttaaagtctcatattacttgctggctgtaatgggaatgtgtaactttgtgaagatgtctgtagccatcttattctaatgatcacttatctttatcaagccattatgtccatcttgacatgatgcaatacacagggcataacattacctacacagtatttctgacataaataaataaactaaaactaatcaaacttttagttctaacaggagacaggaagctagaaaagcaaattaaaggattctacaaagaaacatctagacaaatccagcaggtgagacattccactggacaacaggttcagtcccaccaataatcaatgtcatgaaaaggcaggaaaaaagtgcagtagaggggaagcagtggaaggagaactattaaagattaaagagattttaaagatttaacaacaatgaaatgcacagtctttgaatggatccttgttttaaaaaaaaaaaaaatctgtaacagaggccaggcatggtggctcactcctgtaatcccagcactttgggaggcagagactggaggaccacttgagcccaggagtttaagaccctgtgtctgaaaaaaaaaaaaaaagaaagaaagaaagaaaaaggaaaaaataatctataaaagacatttggagcatttggaggaaaactaggaaaacttgactatgggttggctattaagttattttcgggaatttctgttaactttgttaggtggaaaatggtattgtggttgagtagaaaaatatccttttttgtaatatatactgaagtgaattgtcattttatctgtattttttttaaatactcgagcaaaacaaatagaaaatgtgacaaatgttaacaactgttaaatctaagtgatcattctatagatacttattttattaatctcttctttttggattgtttcaaaaattttataataaaatccttttttaaagtcttcattttgtgggtgggcatggtggttcactcctgtaatcccagcactttggggagccagggcaggtgattgcttgagcccaagagttctaaaccagcctgggcaacatagcaaaactctgtctctacaaaagaatacgaaaatgtcaccaggcgaagtggtgcatgcctgcagtcccagctactagagaggctgaggtgggaggatcacttgaacctgggagatcaaggctcccagtgagccatgagcatgcctctgcactccagcctggataatggagtgagaacctgtctcaaaaaaataaataataaagttttcatttttaaatggccaacaagtctacagcaaatttaaacaatgaaaatatgagatacaatatcttccttaaaaattagcatattttcttaaggaatactgctctgctcgaagaattccctagttctgtaagcgttcgaacaaattaaaatcttgtgtttatataacatatttctaagacaacaatgaattctgtcactaactatatgagtaaaatgaacaagaaaaccactaataatgatggtgcacattttagattccttttattctttttcaagacacagacataactgagatatcttaaaatcactgactttcaagatttgagataatgataataactcaagatcaagtcttccccttgtgttagaagtgggggtgggacagttccagacttccacagttgtaccaatgaaccccaatcagatgattttcaagttacttctccttcaggtgggtgggcatcagagagaagctaagagaaggttttgacaaaatccaaagtgtgtccagacccctcaaataaggtaacctgaccaagtttaatacattcttagggcctaatatggatctcagttaaaaatcctggtctcttttaattcttgtccagttgctaagtgtattatttgacccattaactctgcaagtcatgttggtccattcttcttctttacggttttgcaaaatacatcaggttacagtttcaagtatctgtcacttaaacaagtaagcatttattatttttaatgggagggctaacatattgccacagaaatatagtatgggtactgaagaaaatatacacagactctcaggtcatcactgagccttcccaccatcatcatagatccagcatctgacttccagagtaccaccaagaagaaatcagaggcagatgacatacatatccatggtccttgactctagagagtccagccaaaatgtgtgggtccatttaatcatttctacagaaatgggaggctattgctccaaatgacttctaaccactcactcatccatcactcaaagcatatgatacaattgatttaccagtcattagtaggcaggtagagagtggtgaagcagtggagagagcttggtatttacagctgctattgcaactttggtagcacaaacaacatggaattaggacagggattttcaaagtattgcccacggacttctgagcacctcaagatcttttcagggagtccatgaggtcagaatttttttcataataacagcaaaacattacttgcctttttcgttgtgttgatatttacactgatggtggaaaaacaatgatggataaaactgctggtgccttagcatgaatcaaggcgggggcatcaaatctgtattaataatcatgatattcttcactgccacatattttcaggggaaaaaagttagtttcacttaaaaatgatactgactgtattaccttgctagggctgccataacaaaataccacagactaggcaacttaaacaacagaaatttattttctcatagttctacaggatagaagtccaagatcaaagggctggcagagttggtttcttctaaggacccctcctccatctccaggcagacagcaggcttgccgctgtgccctccagaaaggatggtctttcctctttgtgtggggaacactggtgtctcttctcacagtgtgtccaaatttcctcctcttataaggacatcagtcagattgaattagggccaactttaatgacctcattttaacttaataacttctcaaaaggccctttctgcaaatatagtcacattctgaggttatgggatttagggtttcaacatgaatttggtggaaaacaattcaacccataatactgacaaagcaataacaattattaattttattaaatctcaactttcgagtacatgtctttttagtattctatgtgacaaaatgataagtacacataaagcacttctgttacattccaaattatgattgttatctaagaggaaacacttgtgtggttgtttgagttgcaagctgaactagctactttttccatgaaacacacatttttgcttgaaagaacaattgacaggcaactatggttattcagacttgtagatttgccaggcattttcttaaaaacaaatgaacagagcctgtcatattaaaataaacaacttatagttgttgctaattataaaatcttttttttttttttgacagagtctcactctgtcacccaggggggagtgcagtggtgcaatctcagatcactgcaacctccacctcccgggttcaagtgattctactgcttcagcctctcaagtagctgggattacaggtgctcgccaccacgcccagctaatttttgtacttttagtagagacagggtttcaccatgttggtcaggctggtctcgaactcctgaccttgtgatctgcccaccttggcctcccaaagtactgagattacaggcatgaggcactgcgcctggcctccaccagtactctttagcctctgtcctttgagatgaaaggcgtatatccagggagtcattgccacttcaccctgacctctagaatgaagacacataaaacagacctaaatccaactcacatcttgaagccaagtccaggtggcctgcagaccagtgagcaaaagtgatacatgtttgttgctgtaagcaattgaaattttggggttgttatagatcacaattacaacaaaaatagctgattaatacagatggtgggtcttgagaggattctaccttcatatgcttttaactctatgtctctagcaattatgaaatggcatacctaaaatttttggtggtttcctattatcctcaggacaaaacagtatagcttacttgctcccttaaatgcagttgcattgaactacttacttcctgaatgctctgtgttctttcatatttctttgcttgagatgccctttccttcttctatcccccaattggtccgtagtccctctgtattttcagggtcttagctcagttgtttgcttccctgcgaattcctaaatgactaccccagtgatctgggttaagtgctcacccttttcggaattttcatagcatccagtacttatctctattttcgcactcaaaaccctttttctttcttcttcattaggttgagacccttgagagaagtgatctgtcttgttcatccctgtataccatgtaccagcacagagcctaacccagtgagtgctcagaaagtgccttctgaacccattttaaggatgaggtatctcaggttcagggaagataagctagtaagtgacagagccatggccagatcttcccaactcccaggttctggctcagtgcctggtactaggctgccttatggaatactgccttaacatttgtttagtggtattaaaacacattggtttttaatattagcctgagttaaacatggttggtaagtttaatttgttgtgatttactccataccatatactatattctaaagctgtatagaaatgagtttcacattgtctacatatttggagtattcaagtcatgttctcttccactaagatcaattgcatctctggagaggaatcctcgaatgccacagctgggagatgtttcaaagatcatgtattcactctcctaggttttcagatgagagagtctagaaagatccagagaggtttcacaacttggccaagtcacccaatttcaaaagaacttacaagaaattgggtatctctatcccagtgcagtgatctttttggtacactaggcgaatgtcttctttggtctttcattctggcatttatggtttgagactgtttcagcctgtcagtggatacccttccctggagtggccctaggatagtctgggcaacctggtcctttctttctctgtgtagattttaatcgttatgtgagatgctcttctgcaggaatggggaagagcaggcacaaggtggatgaatcctgaagttcaactattcctggaaggagactgtgtcatgttcttttttccaggcaaactcattttcagaggaaagggacagtgttggaggctgagttgactgtggtacagttcagtcctggctgggttgaggtctcatgcttgggagcaaatatatgggatattaagccaagaaatgaaacagggattaaacaggggcatcctccaggcttagaatatttgggattgtgaactttgagctagtgttatttatctctaccccctgcttctggtattaacacacacggtttgagagttgtagacagactacggcgtgttttaaaaaggataccaggttgtttaacagacttcaaaccatgtcctgggaggaatagctaaaacatatgggagactgtagaccaaaggaagggaggtatcatagtgatcacagtcttcagatatctgtcagagaagagctggcatatcagaagacagttggattctcatgtctgcttatgcactctacctattgcagtatgttggtttggttgaaatatatgagaaaaatctggcctcacatagatatgtagtatgaaaacaaaggagtattttaatagcttgttcaaaatattgtggacatgatattctttatattgcaccataattatttgacaagaggtagtttctttgaaggttagttgcaatgtgaaatctgataccatcttagtgaacttatcatattctgttacattaaaacattggtttatcctgaaatttggatagaacgttcacccatgcatgcttcttaacccatccattagtcacttgagaaaattggttcgctgttaagcagcttccacctgttagcacacattttattattcaataccaaaatattacagtagctaacatcatcactggtctctttaagtcaggaaaaatttttaaatattggtgagctatctacttcacagtgacaaacataaatttcctaaaactctaatttttcctggaagcttagattttctaattagcaggctgggcacggtggcacatacctgtaatcccagcactttgggaggccaaggtgggcagatcacttgaggtcgggcgttcgagaccagcctgaccaacatggtgaaaccccgtctctactaaaaatacaaaaattatctgggtgtggtgggagtggctataatcccagctacttgtgaggctgaagcagtagaatcacttgaacccaggaggtagaggtcgcagtgatctgagatcgcaccactgcactccagtctgagcgacagagtgagactctgtcaaaaaaaaaaaaaaaagattttataattagcaacaacttagcttaggaggctgaggcaggagaatcatttgaacctgggagacaaaggttgcagtgagatgagatcgcaccactgcattccagcctgggcaacagggaaagactccgtctcaaaaaaaaaaaaaaaaaaaaaagagagagtgctggtggaaacccattatgtgacgtgtcttgaagcctcagcttagaactggcacaccgtcacttccactcatattctatgaatcaaaacataatgaagccccaatgtcaatagagcctgtagtaggaagccctgcaaagtcccatggcaaagaacctggaggtacacttctattacagggaggaagtgaagagttgggaagctgcattctcatcaggattcccaacttctgtttcctctaactaatcctattcacaccagtttctgatggctgcttcttgggaaagtcaccagcactagaaggagctcaatgagtctcatatgggtgagtcagaagcttatttcatcaatcagctacctcttgccatttcaaagactagtacctaaggccagctacactcaagagtccaagtgacagttctttattctcacctggttctccccatgaggccttttgctgtatgccatcccattacatcgtctgttattgaagccataacatttcttatttttctcttttcctatttgcttttttttaatcagcaaaagaatgttagactttatatagagagataacgttccttggagtttatggggcaggcatgcagctgtatgtagggtggaaagtcattacaaaggtcataggtaaaatagtcataattaaatcaaaccatggatttggataagactccagggaaagtgtgaagagtaacctttttaaattcctgctccctgttgataaatagcaacaacaacaaaattcctactcttctttcatggttaaagtttaataaggtcactttcgatgagcctatcacctatcatattgctttgttttgacagcactagaacagagatcaaaggcaaacaagaccagtgtcttgtgagccctgaggagaggttttgagaaggcaatgactgggtcaaaactctgaggtcaaacaagattaaaactgaaaatcatccgttgaatttggccagagctgctgcctctgattgctcaggttgtgccttcacaagggcatctggcagagaggagaagtggggctaaaattcaatgcgtgctctgccgccagccaaggccctgatgtggcgttgcatcttccggaaagggaaggccttttataaaccacacaaaagtgcaatctgttcgccaagcttgaacccaaggggctatctctacattcacccagcagggctgccttttctaaatcgcacaaagcaccatatgggctactggcctgaatttagcaactgggaggaggtcaatggaggggacacaattttaaatttacatgaaaaccctttgtaaactgtataacactattcaagtgtaaagcaggaagaggtgattcagaagcttagcaggtgacaggagaaattacactgaccacaagccttttctgcctaacccacagcatgtagaatctccatgagacgtttaagtacccgacaaactcctcagtgggaaaccatttgagggcagactggccagaaagcacagatgggaatggatgtgattatttctaaaagtccattctagtcacaaaccccaaggcagatctagccagtggggcagaagagccccagacagaagcacctgagccagcttggcctgacctaactgtcaggaccctttgatcttgctggagcttgacttggagaaaacatctggttctggggattctcaggggccatatagtgtgaaaccgaggggaagtttttgtaaagctctgtagcactgtgactgggggatacgcacagtgctacaaaacctacagagacctgtacaaaaactgcaggggcaaaagtgccatttccctgggatatcctcaccctgggtcccatgcctcaggagacaaacacagcaagcagcttccctccctgctttggggcctggaagggatagcaggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtcatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagtaagtaactcatttatttatctgaagtttaaggttaaggcatcctccatctaaggaggcagaaataatcctgaaatgggaaatgggtgaaatagctagcatttaggaggactcctgggaagaggtgaaatatggttaatcctttccataggagaggagcagaaggtgtctgtaaaaaaagagtttggggcatatgaagggacccttctggctcagaggaaacagagaactctgcccagtccatcgaatttgggtcaggctgtagaaaccacagagtcattggcccaactccctgagcagagtcagaatggacacagaatgaagctgacttgagtccaggtggttttaccaacgtgattccaaacgttctgacctcccttatgccaaacacatcctcctggaagagctcagaactgaatccgtctcctgggcatggagggtggggcgagcgcaagtagtccctggtgttgcgatatttctctttagaagaaaataacctgtttcagacatttgtttctaattgtttgagctgcaaatgaaaactaggttactagtgagaaatatgggacattctggttcccactgagaccagattccaagcaggacaaagtgaatgtgtagtgcttccaactaagaaatgctttgaagtctccaggacacagccaggagagttccctaccactcaccagtgttcatcgtttttgcaaagagtatatggtgccagtcacttattaacagttatgcaagaatcaatgctaaggttgttgaaggattgtgctcaacacagaaggcatctttggtgtcctttcaatgacatttgaattcgaccgtgtcttgctaaaaaataaaataaaataagacagtggtctccacctggcagcagattccagttagatagtacatattaatcttaagtaagaaaatgtaataaaccaatacaaaaacccatttcgaaggtcctagggaagtctagcaataggggtcagtggtcccaaatctgcccaaccagctgttggaaaagaaacagcatgccctgccctggctgggactttggcactcagctcaggtttttcaaggtaaaagaaggctctagagagatagggtggtgatggtgggctcttctcagagaccaaatggggacaaagcagttccaggcatatgcaggcaaggaggctgaggaaggggaaggacaggcatgagcaacccaagacctcacacactgcagggagaaaaggggcaggggccctgccgtcagggagaaagacacccaaagttgtgctagtggagtcagtgcagagatgttcagacttttttaaaaaatcaacatcttagtaagattttgaaattttaactaatttgggcctttgcctttagaccttattatccttaaaattttcactaaaataagtttatccacaattccaacaaagctaaagactgattatcctaatttccctttgtttgccaagtaagggatgaattaagttcctctgtttacccatttacttggtccatatttccctaactgcggagtgcacagcacatattttcagatggagagacgttctttttatttgcatggatctatcttttaatggctatcagaatagtacaactaggctatcaaacccatgtgatttcaagtttccttttaattatattttaagttaaaaagtgaataaatttttttaaattattaagcaaattatgacagatgactatgaccaaaaaagcgggggagatgtgcttaattgaagtttgggaagtgctgaacttcatattggtgcatttcatcagcctttgaagtgaaaaagtaaggggtatccagagggggcacaacctagaatatctttgaatggcagcttctatttttaagctaccaacattggattaaagagactgcactgcaaacccagggcctttatcttctcagaagccttttgatgctttttttttccttgggagcttctttcaagttcttacttacggagctcctgggtagcacaaaactaacagaacaggtctatacaaacccacagctgtagatcccacactttagtcctctggatacagtaaacctggagagaccacttagcttcgtaaaacagaacagagaaacaggacaaaacagcatggaataaagtaatggaaacgtgtacttctatggtaacaacagcggcagtggggaaaagaggcatggtcgttgggaacatctgcgtggaagtgggccatgtgatggactttgaatgcaatctattattgtatgtcacaattatgtaactaccactttttgagtgcctaccatttattaggccactgggctaagtcctttaatgattatcacttcactcagtcctcactacgatcatgtggaattgaggtaccatgacttgcgttttatggatcaggaaactgaatcttaaaggggttcctcaagatcacacagcttagtaaagtcatcatttgaatcacctgcttgatgccagcatctgtgctcttaagaagtctgctcttccatcagggctgcagctagactagggcatgtgtggaggtttttcctgcctggcccagcctctgcctcaggtctctaatgagctccttttcaagctgaatcagaaacaacagttatgccacttcccttccagtgccatccccatcacttctctcaccaaggaagaacttctgaacccccgccaaaaccagttacccaaagcagcattccccttccccaggaggagccaggtgaggcccatctctcacattacacccctggagacccagggtccctaaatacagaaaggtccagacgatgatcagagcatcactctttccctcaagaaaaggagtccacataattctggcctcatcaaaatgtttctcagattccaaaagatgaccttcccattcctccaggcccactagcccttggcctggcatctggcactccctctcactcccagtcagcatctcccagaacagagcctttgcacctgcaagtccttccacctggagccattttctcccagggactcacacagttttctccctcccctcctccaggtctccactcaaatgtcatttccagtgaatcctttccctaccacctcatgtcactctgaagacccctttccctgctttatttatagccctcatgtctacttgaatctttatatgctcgtttactgtctgtttcccttgctctgtgagagaaaggactttgagttgtttcttactgcacctataagtacactgaaagcactaaacaaacatttgttgaatgagtgaatgaataaataaaggaatgaatgaatcagagaaaaagtcagctatggtataaagcaaaagaaaagaaaaatgaagggaagctggtaacctacagagccgagcctgagtcctggctctgcaacccatcacaggtctctgccacgaagtgccaggcactgttctgggtgccagggaatcgacatgaacaaagcaggcatgaacttctgccatattggagcttattttctaatggcaaaagacagatggtaaactaaataaataaataaaaaatatatacagtgcgttagggtggtaataagccctgagaagaaaaataaagccgggaaggagaataaagaggactagtgggagggaccagcatgcagttttaaacagaagagtcacagaaggtctcactggaaaggtgacagtggagcagagacccgaggaggtggtaaagtgaggcatgcagacctctggagagagagcacttccaggcagaggggacacagggctgcctggggtgtgtggctggaggaggggagggagtgatggggagagaatgtgaaaatgaggtcagattggtgatgggttggggagagggtggcttgtaggccactgtaaggactactgcttttggattcgaaagggaagattggggagtagaatggaagtcacacgtaacctagagaaaagatctagagagacagaaacctgaataccagtcctaacccacggccctaagaagtgggcaccctcttcatatcacataacaccaaaaaatagcttctgttctttttcagcaacctgtcccaacaatccttcctgcttgggagctctgttcttagtgcaattacattccccacgcttctagtaaaatgtatcttctctgagtttagccctaataaacattctaataattacatcgagtctctctagttcacagatgctgtatctaatcttataacctataatacggaagatgttatcctcacttcgtagagaaaccagataaagctcagtgagtttaaggaacttggccaagattacacacttggaaagggacagagtcaaaactaggttttggatcttctgacatccttctactttacaacgactaggaaccacccttcatgttagtgattctccaactatcatctacagtcttttaaggattgtaaactgatccgaaaaatccatattccctccttggtttttatgagtgacatacaggcaatctcatagattctgatgttcacgtataacagaaattaatttaactgtcacttctaagtgtgagagtgtcattgaagcttgctaaaatttgatatgcatgaatgtgttattaaaatggatggaaaaacttaattctattttgtactaagcagtttggctgctgcacaatacttggcaatgatgcaaaactctcagatatgaaataaatttcccctaaaaggttggaatgcatggtatatataacctgctaggtccctgcctcacctaagtgtagcccgaaggtggagaaccactgctctatgaccaacgttccacccttctttcctcttgatcaaaccaaaaaacatctttccagtctatattcattctctcttatttgagcacaaattctgtcagattgtaatatgggcaaaagcttggatttctatttgatgctagagtcacctcttgttccatcctgaaggacaacctctaagacggaggagaagaggctaggccagatgggacagaaaatcacatgggatgaatatcatgtgacttggcaactggggctagggttgccgtaaagggaaaagcaaggtagtttttggattaggtatgtcagctgtgccagacccctgatctttggcaaaggaacctatctggaggtacaacaacgtaagtaacctacttttccttcttatgaccactatgtttggcaattacatttgttaaatatttttctaagtcaccaggttaggaagcagtgctccagtaggtaatatagcaagggatggcttgaggaacaggaactgagtttccgataaaatccaggatggcgtctgtgcttcagtgagccgtcttgatccattgtccttcctagagagtttctattccctctacctggctccagaaagctaccctcctcaacatctatgcatccaccatgtacagatctaggccaccactgtgatcagactcacatgacagcacttcggggggtggacacaaggtgaaatgaggagcacgctgaaccagtaaatcagaggccaagttccaatctgtccaatgcattaactgacaatgcattagctgacaaactctgtgacttaactgcactgaactatagtttccctatagttagatgaaggatttccaagctgtcttccagcccttgcccactatgatcctgattatccccagaccaattcttatgaacaattgggaggaaaagcaaggaagcccaatggtgtgactgtcctattacccagtaggaattctgtgatttaatggaaaaaaaaaaaaaggcactggaaagggagtgaaaactctccctatgcatcccttaattagcccttgtgtgatcacagaggtttggaaaaatgatgccttgaggctcctttcagtcctaccatctattactctggttcaggggctggaaactggaaattgagtgaagcccaactcagccactcacttaaccacctttacagtgcctttgtctgtgagatggatctaaaaatatcacctcatagagtttatttcaataactttgttgaagtagtataaacaccagctgtttaagtaggaaagtatttatacaaatcatagtcatctgtgattattatagtcctttggatagaccccaagtcttttgcatcaatggctcttgctccaaccattgtgtccttccacctctcgctgaggcacagtcctgttgtgattgatttagttgaggcttgttgttacgtttctgcctacaacggccatttggcaattctcagcaaaatatgtgaaaatgttatcctgaagcaagatctgggagtaagagatggcaggttgaggagataatagcagaaaatctaaggacttgcctaagtgtcaaaactcagaagatagcagacatcaaaaaagctgccaaaatataatgctcagatctcagaaacccttgcaaagctctgtctccagctacacccattctgctccacccacccacttccaaacagatgaattagactgacagggagcaaataggtagcaaggtttttcgtaatgatgcctgtggtagtgctttgacagcacaactcttctttggaaagggaacacaactcatcgtggaaccaggtaagttatgcattttactacagctcagtgtgtatatttctttagggttgttgtagcgtagtcctgaatgaatggggcttcttgggaagtaaagagttccaaattagaaacccattgtttgttgcaaacagtaggggtaaaatttgggagcaaatgcattagatttctcttaagaaaatattctgtatatgcttggaaactccattctgaggcttggtattcataagttttttacaactactgaaaaaaagccctaggtcaggcttttagttttgggctccctagaaccaggaaaaaggcaagctgtggttgaggagggtctctccagtatttatgagggataaaagtcatggtcacagtgtaggaagagggaaggttagaaagaaaaaagtattacgaaagaaggagttttaaaaagaggatctttctctcctctctctctctctctctctctctctctctctggataagaagccaatcttgcccttgtcacttttttctgaacttgcattaaaccaacataaatggttcagattaaatggttctcaaggtcccatcctggcctgggtctgctgagagcagttatgagctcacctctcctgttagccctgaaactgggaactttgcacaatggttcaggagcctgtatccaatgtagaaacacagccaccaactccaggacaatagagaagtcgtggtcccctactggagacattgtctactggtagcctactccaatgtttggaaatccaggggctatattctggtagtttgggtagctgccaacagtcaatcactaagaccagtccagagaatagccttcagacaccttccaaaatgccaagtccattgggagagccattacctcttacatgattaggtattgattttgtttattcagaggaaataaataagtagggaatggtacatgaatgtggctaggctatctgaccaaaagtccaaaaagtgactggtgctgtcaacatggtctctgcctctcagagaataatataaacttatagggattctccactgcctgttgcctccagggaaatggtagaatttggtgagttttcttatctttgaggggagagagactagagcactgaaaaggagggaaacagaatcatgtcgtagctgattgtagtctgattgatgtttagcaaattgcatctgagcaaaaactactgtgtttcattttcccctaaaatcatttccacttgaaatttggaattatctgcagtgttagaatcaaatctttgaggctgtgcctttgggagtcttagggaagaaggaaattgatgaaactgatgcttagcccctctgccaggatgctgaccatgctccccgatgacactccattcgcttctctggttttcttctcctgcagtggtgaaatgtaatatgatgatgtgaagctcaggtaggggatgtgaaaattttcaaatcaaaccccaagtccttaaagctttgacagtgaataatggccctacacaactgtcattctcttttgcctggctctagcccaacgatcttgatttttggtgatgaggcagagtaattcacatggtctttatgttacattgcacatgatgactatatactcctgaaacttatatctggatccagagtcaggagaaattataaaacaaaaataagcaatgcaaagcaagcactggcttctctgacctgtgtccatgacacacagcaccagtgggctccctgagcagtgaccaatttcttgttcaaccctcaggtccttagaaagcctttcgccaagctcagggaattagaaagcaggttcgttattattgtgagactcagtctgagtgatgggggaaattaggtttctaatcaaaattctgtacttgtgacccaagagaatggaaccagagtataataagaatggaaactctttctataaccctcctctcctcaacctaacatttgttgtaagaaaggtcaagttaagtgccccatccctaccctcaagctattgtgttcttcttggatgcccctctcaataaactggaagttagattttccatcatgaaggcagctatttgtcacctgccaccctcttctcttgctctgtctcagccctgccctagtatctcttggatggggatatcaccctcacatctctatcaagcagttcaactattattagcttcaaagggaactgagactctgtgtactcagccccttggtctcatcaagagcagctttgtagttctctgagctgtggggtctctaggctgagaactgaggctggggaggcagggcacagatgttacagctcaggccccagggccagctccaggctagttacctgtgaggcactgtcataatgtgctcctgggacacccgacagatgtttttcggaactggcatcaaactcttcgtggagccccgtgagttgatctttttcctatatttctgggataatttgagtcctggcactggggctgcaatccagtttgcattataaattataactagtaaatgaaattataacaaggagacagagtattacagatgtgaaataggccagagtgaacacactagactgagtcacttaagtagctctgtaactctatttattttaatatatatactctatattaaaacaatagctcccatttatttctgaaatcttcagagcagcccaaaaaacacaaagaaatctagaagaactacactaagagttggagcattcaggtgcaagggagacagtgggagggatacttcagccccaattcctcaggaagctgcttcatctctgcacatccctttggctaagctaactagtatgcgtgcctccttgcaaactgaaaacaagtgtcctacagcttggaagattctggagaaaggtagttagcatggtcagagtaattaggtagaacaaacttttatttcagggtttaagttaaatcccatattggcagaaagtcttgaaattctgagtgacatttattacagttgttgcaattcttaggggatcagtaggactagctatgagaatctaaaacataggtgacttctaagtttataaattaagaaagactgttcaggaatggtacacacttttttggtattgtttaccagcacataaacttagcaatgtattggtgttcataaaaagagaaagtctgacaataaagcaattttccaaagaaataacacttgaaacacatgttgcaatgtaattatatttgtggactaagaaaaaaagactacaagttcttcaaagataaacgattaaatctttaatctaaattctggactacaatttcatacagcttcacgtctgggtttaagtcaaatacaaaatagactaggatgcatatggcaactatattgagtgcactccagtttttaaaaaggtttaattcagtcagacacccatttctttggttaccaagatgccaaacaatggattctataagacactttctttcaaacaatcgttttgaaaatataaacattaatgtagaaagagggattcagaaaaatgttttatcaaatcaatgtattatgctctatctgaaatgctgactaacagagtcagagcacaatatcataagtgcatgaccttcttcagacatctgtcttttcagttatattgtattattcaaattactcaaacccaatctccccagcccaaagtgatgatttgacaactgcctgatgaatttagcttttaaaattctagcaagccttaattatccaactaaatcagaccaggattaagagatactcttaaataaacaaggagatagggtgtttattttatggacaagtttcttttgtaacttgtaactcccttgaaagtcagccagagtatgtctcaaaccaaagtcaagatagtgagcaagaagtgttgcacttatgaagggaggtgagtgagcaatgcatgtggtttccaaccgttaatgctagagttatcactttctgttatcaagtggcttcagctatgcaaggaaaccaaacaggggaagttttctcaagcaggttgaaagcaggttccaagaaagccctttgaaaaatgtctaatcctttcaattgtctagaactaaagccaaaaacataaggaaccagattcttaggaataagtttcctgccctgagtgactgaaacagaatcagtcttttagttgagcttctcagcagaggaaacggggagaatgatgatggtagtgatggggggtttctctgaatagttgattttctaggaaaaccatgatcaactttggtccatttacaaagccgtgatcagcagaaacttcctgactagcaatcgccccctctcaaccagatataaccagttgatctggcagtagctctgctgctgtgaacctcacagctgaagcccaaattcagattcaggataaagcattagaaaaattatttatttttatacagaaaattagccaggtgtggtggtgtgcacctgtggtcccagctactcggaagactgaggctggaggagagtctgagccaggaggcagaggttgcaatgagttgatattgggccacttcactccaacctgggtggaaaagaccctgtctcaaaaaaaaaaaaaaaaaaggaaaaggaaaattacttattttccatttacacattcattaccaactttctgttcagcaacacctaatgtcttgattatagaccatagtaggtaaaagtacactggaattcaatgtatttttcatttgatatcaagaagcaaaattcacctaagtttcaaatactaagggccaaatttacaggagcaattaatattaaaagtcagcattaaatttaggattgaaaaatgtatcttgatcatcattcacaggttggttgtgtttcttggtttcaggtattaacagggctctttctttaacagttatttgaagatagcctaagaatttaagtccccatggacacaacatttatcacaattcaaaaacttcagtgaggcactgtgtgaaagaatcatcactacctctctcaaagcttcaagacttgtggtcttaaggaaagaaaagtatgcatgtacagggtggtagtccaaagtgaggcacaaaagaagagaaggccaggagggaagccaatcctgggaccaacattccacagttcctcttagattaaaacaagaatgaacgggcttcaattggttttatttctttaaggacttcctgaaaatgatcattgttatcctctgattaaagactcaaaggaaactatacagtagtcagtcccctacagaagaatgagtattcacctaaaggcagaaacatgtaccacctaccttcagcagatccctttccaccctttccagcagatctggaagggatggcacccttccgggaccccaacactgccatcctcagaacctctgagccagttatgcagtccttctcagaccctcgattctttaagtgacagaatgcatagcatgagcacctgccctgatctaccatccaagggcccatgcatttacaaaaaaccaactggtgcagagagatattcagcctgacctagattgtccagaggattgattaataaaacacagataatcggctggatgcagtggttcacacctgtaattccagcactttgggaggccaaggtgggcggatcacctgaggtcgggagttcgagaccagcctgaccaacatggagaaaccccatctctactaaaaataaaaaaaattagctgggcatggtgatgcatgcctgtaatcccagctactcgggaggctgaggcaggagaatcacttgaacccgggaggcggaggttgcagtgagccgagattgcaccattgcactccagcctgggcaacaagagtgaaactctatctcaaaaaaaaagaaaaagaaaaaaaagaaagaaaaagaaaaaagccacagataatcgaaacccagatgatccagaaacttctttgtagttgtcattttccatctgtgcttccagccctatctcctagcagctcctaactggaagtcaaacttactgcctttcatttctgctccccttgcctgtcctttcacagaggtggtaataagcccaggtcactaacaggatgcatggaggtctggattgtagtgtttggctccagggtaatcgaggtaatcaccactgtttaacccccacaaagttgtgaataatcatctcacctaataagttgattatatttgcaggaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacaggtaggccatttctagcttcaaggagctggagattatggggaacaagaattgggtgaaagggaagttagagatgtaactgtggacaaatcattctcagtatagcatcatgctggaaataagacttaggcccaactatagcctgccattggcaggggagggaaatgcttgtcatccctaagatggaatctaaaataaagcccatcttatttcttcctcatctctcctctttacctaccactgtccccttcatactagactctgggattgaaagtcctcgtgcattctaatccagtgctaaattccaacaaagggcaatgcggcctattgtggggctaagaatcctagttcttcccgcatattggtgtgcctggatgttgacctcatggtacaatgaaaaaggctagaatgggaagcatgttgtataattagctatgtgaccttcaccaagtcacatcctctggtcctcagttcactcacccaaagtctcctccagttttaaaagcctacaatcctgtgagcctcttcattcccaatgtaaccctgaccactgctgtttgttccagatcacgtaaaaccaaaggaaactgaaaacacaaagcaaccttcaaagagctgccataaacccaaaggttagttcaaatcaaagggccaacttcagaatcaagggttaaagcaaactctgtaattgtccactggggccaaaatgtatcagatttcaaaagaaaacacaaaccatgctgagcccagttggttctgcagagcctctgactctcccagcaaggcttacctggctgtcggcatcggtttcccaagcttgcctggctgggtgtcagcagcagcctaaggtctctgacggctatctggcaccatgctggacttgcaggccagaaagaactaggcagacttggggcaggctaatatcagtgttgcaggcccaatttctggaagggaatttaatctctccctgaagccaccctcttcactctttttcagccatagttcataccgagaaggtgaacatgatgtccctcacagtgcttgggctacgaatgctgtttgcaaagactgttgccgtcaattttctcttgactgccaagttatttttcttgtaaggtaagaattagccgcttcttattcctatctctacccacaccatgctgcacatggggaaaggggatttagaaatggctaagaaaccaagaagcattggaaagggaaaatagagacatacttagaattaataaggtaggctatctcagctactcagcaaaacagcaccccatttcctgttatcctttcattttgagtcagactgaaacccattaggtagtataatgtactatttttctaatataccagagaataaccctcactttcactccagggagaaaactgaagataaataaggagaattcatcttctttactgctattttgttcatcgaccaagagaccatgggttatttgcaaggccataagtaaagctttgcctgaagactatccagaggaagcagaacctatctttgtcctgataaagggaatgccagctcacactccttaatcataggaccagcctgtctatgtgtggatcagcctgtctttgggatgaacctacacacagcattagtagtgaacagctcactattagctactcaggatgcatacacagttaggtttgagatgtcaattatttgcctgttacttgcattccgttctcaggtaatctcatacacgaaattgaaaccagggcctgggtttgcgtgtgaggcttctccccctcactccttctccaatactcacaaatgctcatcaaccccagcttctgttctaggaacaaccctagactcagagtacttgactgatctgacccagacagtaaacatacccagtcatctcaaaaagggggtccagctcacctgttattttactaacagtcccagggacacaggcagtgtggctgggtaaaaagagagctatactaagagtcagaagatctgggttttatcctgattttgacactaacttacatgttaccttagccaggtttcttcatctctctgggcctgggtttttgcatctgcaaaacaaatgagttaaaaaaaataataaccaaaggagaacaaaagagtctcatgacttgtgccaacactgatagctgaactagctgagctattgccatgtgtacatggaaagtgagccacaatagattagtgatgtctgcaatggtacagtatagcaagtaccggccaaccccagactacatgacccctacgattccttctagcactggcagtctattctataacaactttcttcactgcaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggaggacaaagtttcagcactttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgatttaacatgcatgaattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaactgcattgtgtgcacctcgcctctggctttactctttgcagatcaccacagggggaaactcagctctgtgagctcactattagtcagccaaaagccaaattgaacttatgggtcacactgcactttcctgagccccaagcctacagaggccctgccttggagacccagcctcgggtttcctgctgcctctgctgatgccgctgttacagcaagagcaacagcagcacctgcagcgtggccagtgacctctgctactgccacccaggaaggccacagccttttccaggagcactgctcaggtgcagagccctagcaacccattattgtggttctctcagcacctatgtggagcatcaagtcgggggttatgaggttacaagtgaaagagtgactgtcgccaacaactccacttgccatccccgacagcaaactcccccatcatgtctactacaccttgtatgtgtaaggaatgctgatttccaaaacattcacgagttaccttgtgtaatattagggtgtttcctctgaagttgttaggaacaaaaagatcatattctcatttttcagataaaacaaaaatgccctctcctcaaaaaagtatgtatcatgtccagagtcattcagtgaggcagggatattgctgggagcagaaccaaggtctcaagattttcagcccaaagttcctgctataagaacatactgcatccccaaatgaggacaagatgtcaaagtgagtatcagctagaatgaacttcaggattgtcccatatttagcatataaatgagccaccctctagcccactatgccagaaacaaaaaaaatcctggcatatcacaggaccatgaatttcccacaccaaaaggagcctccagggaagatttaaggcaagagccaggagggattatggctgccttctgatctggggccatgatatgtgaactgtgagatggacatgtgtcacactcagtaggcattagaacagaagccccagaaagccaagccacatgcccaaggtctttggctccctcatcccctgttctttccattgttctatacagtggctactcttgtccactgtttctgaagagcacataaactgctgcccaaaccactcactgatagagccacctagggtacagctgcagaagagagccctggaagtgtaacgctgcatctctgggcctgtcattatccaggtatacgactttgagaatgtccaccatgtctctggactgcagtgtagtttctataaaataacatgtaaggcctcttctatttctaagattatatctaataactctaatagttctattaaggcagataattcaagagaagaggaaggagggactgattcccagggactgagggtgtgtatctatttcaacatcacatagtcagtttgccccagaggaaattttctctgccggagacaccactgagcttcaaactcagggacttggcagctggaattctggaagtcacaactttccaggagtgcctcagtgctctgcagtgaaaaaaaagaaaatgttctccaaataaaataagtaaaatggaggtgtcaaagaacatcaaggagaaggtggctggatataaaaagatgcgggaaaaaaaaagtaaattggtgaaaagtcttttaagtaaataactttgtgtctaacttaattttttttttttttttgagacagaatctcgctctgtcacccaggctggaatgcagtggcaccacctcggctcactgcaacctctgcctcctgggttcaagcgattcttgtgcctcagcctcccgagtagccgggactacgggcgcgagccaccacgcccggctaattcttgtatttttagtagagacgggtcttcgccatgttggccaagctggtcttgaactcctggcctcaagtgatctgcccgcctcagcctcccaaagtgttgcaattattggcatgagccaccacatctggccctaatttaattctgcaatgaaaacagatcaattcataataatggataaatggtggtggtgactaaaataaagacacggctgacggcctcgccttagatgggccctttacctgcacctgaacctgcatcctgaaacactcacagaaaatgcagcacaggcttgtcaagcccctttctgtatcgggacgaccagggcaccaggggcacgaagacagcgctctgtaaacatgcagttctcctttgcctaccaggagtcattcaggtggcaagggccccgtgagtcagaagtggggagatactctgcttctctgaagccagggtgctcccctggatctgaccaggccatttatttctcagaagacactttaggtcacttctaaaggccaggctggaacccaaaatggctaagagaaggatgccaagtcccagacatgacctgccctaagaggcagctctgctgagctgtgccccaggagtttgtgttatgacttcctgggcacctgcatcatagtgctaaaggcacagtagtaagtggcactgtcttcagtccttactggagagatcaccaagtgaaaggctttctgggtcagaatgtgtttcacagaaaaccgtccttgagtaaaatctgcaccttctgatctgctgttatccccataaaagacaaactgaaaggaataatctggccttatccggtaccagaataaatctggatttgaatatacagtgtcgtaagtgcagagcagtaccacctcactgccactcgccaccgtctggtccggggaactctgggttactttgtcacacagcgtgcccctgtctgggaaaaagacaatgaggaaatagtgaattctgcaccccccagacagtgagtacagcacatgcctagcccagaagaactcaatgagcagaggcaagagaaggacacagaaataaagccaaaggcagcaaataaccaaaaaccaagagtgcaagagaaaaagccttcaagagtcagagaaggagaaatggggttatagagcaagtggaatgtaaacaaatgaaactacttacagaaaaacaaaaagctaaagcccacagtaagaatcatcttttcttcatatcagggcagaggatatacaacaaaacagggttcctaagatctcagagactatctgacggttctaatgaaagaagacgggaggaaaacaagaggagactggcagcgctgacggtcatgtgactgattcagctgtgacttctagaggcaaatgcgctcagccaaggaaactgctattgctattatgattttggccccaatccatcttgaactaacacatatgacaatgaaaaatggattacttttaaaaaagaaaagaaaagaaaaacaaaggaagggagagagagaggaagtgagggaggaaagaaaactgcaagactaatgatggcgttcttggatatccaactgctacaaaagtagttcactctccatttctgtatcctctggtcacagactggtgtactagtccattaatcacatgtcgtactttgagtgacactgtctcatagcatctagcacggctccacacactttgttctattcaataaatggaataagtgaaagagtaccttggacaactcccttactcctctgtgtaaagaggaaggaaagggggttggaccagattctttctaaaatctgtcctagacctgaattccagaaatctttgatttcagatgcttgagggagtgtcctgatcctaagtgcttcttgcacttcaccagcttgactttccatctctcactgggcccactgcagcacacacttggctccagctggaaaatcctgaacagagcttcccggcaggtgaactgccataagtgggttataagcttgctgagatagtgttcagagtgcccatgtacctggggtggctggagcccctgagccagcccctcccagtcaggagcactacaaatacagttttccatgtaagccatcaatatgacaacagttgggaggcactgctgtgaaaaacagaacactgactaactcactccccaaaatgcaggagtgttcctaggagtatttctagaaggtccttcatttccctttttccctacatccacttcatcagtaagacctgtcagttctaccatgaaaatatatctccaatccatctacttcttccatctccactgcaaccaccttctataaacaccatcatctcttacagggactgcttcaataacccactaactggcccccttgcttctgctcttgtccctggacaatccattctccagttcttcataaaatgtacatcagatgatgacagctggacctccttcccaggcctgtaacatctgcaaacgatctggcccttgcttcctccccagcctcacctcacatctgctccttctctttcttcccttcagctgcagtggccttccttctcgtcctttctatgtctctcttttctagctacctgaaactctgtctccaatttttcacagttctcagctccaactaaattagtcacccatgccacccataaccaacctcaattacatctctgttcttattttccctcacatcactatctgaaatcatcagattcatacatgtttattttatgtctctcccatctcacctctcccctacacacacacacacacacacacacacacacacacacacacacacacacacacacgataatataaactatatgagggcagggagcttatcttttcactgatatgtctccagcccctgggcttgtgttgaccgcatcacagacaatcagtaaatatctgtgtaaaaaaaaggaatgcaatttcttcacttaaaaactcaccattcacctagatttaggaaataaaaatacaagacacccagttaaatgtgcatttcaaataaacaacaaaaatttcagtaatacgggtagctgggacatgccatatttggaacacatttatactaaaaaagtattcattgtttatctgaaattcaaattccactgggcatcctgtgttttatctggcaatgctaggcatgcagaataccaaaagtaagcaccaggcaggccagagtcccaccatgagcatcttcagggcccctggatgtggaagagggatgttgagggcccaggggctgccttgccggtgcattggctgcccaggcctgcactgccgcctgccggcaggggtccagtccacgagacccagctccctgctggcggaagtccatttcagagcttccggttctcccaagtccaaggattatgctcactccccacccacagtctcttagtgtctgtccctgctctaaagatgttgtctgggcttgatattaatatgagagctgactgttcccttcctgatctagaccataaccatcttcaagttaaattgctcctcctcttctaactgcccaacctcacccacgtctgaccatacccaagcacagagaagtgggtttaatggaccttcacacagaaggacacatcctctcctataatgctttacatggaaggttcagacataacctgagtcctgcttggggtagcatcatcatgactctcttgccctggtgtccttgcaatattccttgaaaggcatccctcccccaaggaagggcaggcactgagcacagcaatgcagtataatggctaagagtgggatcccggagccagcctgcttgggttcacatcagctccggcttttaccagttgtgtgaccttaagcatgccctaactctccaagtctcaattgctccatctgcaaaatggagatagtaatagcttttctcacaggactattggaaaatttagtgaggtcacacatgcaatacacccagcagataaatgatctatgaatgtcaggtattgctgttgcatatttaatttaaatgttgccatttttattaaatagacatatgaatagagttcctaagagtgttactctcatcaatgctgctcagggaaaagatgctgagtaaatctaaattttaaagttgcaaaatctagcaaaagattgttgatatgttgtatcaatcaatggttaaaaaaaaaagactgacatctttaatttgctttcagtgctgcaagcatgtcctagagctccgtgatcccctgagacctgtgatcctctgagacatgagccagctgtgctctccccaagtccctaagagcattaggagcatgagaagtgagcattccagccccttgttcttatgtcttccaaacattgtaacaggcttgttcatgagaggccacaatgcatgatcaagtgaccccaccactgaggaataggagaaagcctcaagattcagtggcccactaaggacgtattgccctaagtttctccaacccatcttcctattggcatctggagactatgcctcttcccaaggtgctgagggtgctgcagaccccacttgccctgcaggccccacccgcccaccagcgaagaagggctgcctttcattagcccaaaactgccactcaagaggggtcctcagacaaggtgggagccaagagatttggcgaacgtcacccttgtcccacagcttggatcttgatcactcatatcactcagaagagggacttttctctcttgtttcctttgaggtgggcggctttgtttttgacattgtagcgccctctgctgctactaattatcgcatctccataaataggtcatactggaggttgatagaaaatagatcagggaaggaaaacattctttgttcacaattcaagtcaaagctgctgcttctgtctccattcccttttcaactctgagactggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccgctggagcagcctgtagcaagaacagtcttggtccaaccaggtcagtgatactttttatgatggggctgtgtgggacctgacctgactcttgctaaccagatttctaaagccatctgcagggtcttttctcctattattccccagggcagggagggcaaacagattatatctccattatcaagagctaacaattggtagagactatgcggagcatgctggtaagaaagattctgaggccacatctatactcagaggaagagagtgatgtgtttattagcaatatttaccaagggagcagaagcaggaggcaaccccacaccattttgtatttcccattcctgctctcgatgtcattccctgaaatgagtcctgcagagaaagaataatcagagccaattctccattggattgtccttttggtaaagggcaaatttttccatttctgtcttttccatggaccatttcccctgctatcaattgctgttgcctgcagcctaagaaataaaatttttaaataaatgagaacgttctataattctctctaaaatcataaacaatgtgtcaaggccaaacacttccctggtgtgatttattcctatgtggactcatccttgtataattagcaggaataatcacaccctgagccagctggcagagcccctggggacagagaccacccaaagaaggtccttgttctcctgagtcacataaagggagtcacacaaggcgggagtggaactcaggtgtccggagttctagtcccagctctgcttctacctatctacatgaccttgagcaaatttatcccgcagagcttcagcattttcatctctaaaatgagggcattggcccaggcagctgttaaatttccttccaagtctcacattctaggatgctaatgtgtaaaattatagaactgacccaagagttattagttcatatccccctgtgcatgttgcttgaactcctcattgcccagcaggaggaaaagggaaaacatgtttcttcattggggggtagcataatttcctggttgactatgtgtgactcatcagagcctggcggtccaagcccatatgccatttgaaatccggttattattacatctgggagagagaaaagtgctgaaaacagcctttgggacactatcgatttggccaaaaaaaaaagaagaagaagaagaaggctctgtctagtgtgataacattttgttatcttattcattgtcttcatccctgaaatacactctgctctctcctatctctgctctgaaaggcagaaagagggcagccctctccaaggcaaaatggggctcctgtggggaacagaggggtgcctctgtcaacaaaggtgatgccacatccctttcaaccatgctgacacctctggtttttgtaaaggtgcccactcctgtgggtaccgggttaataggaaactgacatttggagccaacactagaggaatcatgaaactcagcaagtaatatttggcagaatttttttttctatctgaaaattatcagtgagagattctaatgtgccttaacaaacaggaacaaaagatgagtgtttaatacaattcaatttaacaaatatttattaagagcctacagttattcccatggatcatctgagtcagtttccgaggaaacattatcgttgccttaagggagctggggggttgtcaacgggccagaggtgggatgaaaaatgacaacagatttacctctgggaccgggacatggttaaccacagcggccctgggtaagtagcttagcttcagaagaaaatgtgcccaacagcatgggtaacctaaaacaccgggcaatccaaatattcttttatgattggctttagcatgtattttattcttttgtagggcaggtttatctcaccaattatatattttcttaactgacctgtaaaatctacaggggaaaagtattttaagaattatatgtttctgcaattaggctcccagcagtcaacaaagaagtggtactttttgtctttccagtgatgaaaaagggaacctggcatccctggtggcccaccagcgtctccttccctggcctaggtcagaacaagccgtaaatcagcaggccgttatcttcttataaatctgtagagcagggtggacaacaaaaggcagcctgctaggttttcagaacatgagttccttgtgtagccagagaacctgggaccatcctgacgtggctggtcctgctgtcctcacagcctgaatcccaggctgtatgaataggagaggttcaagtccagatgactgttcacgatgctggtcccccttgcatccctaatcatgctagagacatgaccagggtctgagaggaggaagttacagcacagcaccaacaggggcttttggtaaagggcctgggcactatgtgaagatcacctagatgctcaactttgggaaggggactgagttaattgtgagcctgggtgagtacctcaactccagaggtagctttagcggaacccctctatacctaacacctggcaatcagagggctgaaacacttggccagataatgaattctcttatccggtgggaaaaggctgtaaagatcaaaccacctttcctatgggtaagcaagagtctgtagtttatgtaaaggcagcagctcctgtgggaaggaaggaaacaggaaatttacatttggaatggggacgcaagtgagagtgaagctatctttaaaccaaaggtgtcaggttatttggtttggtttttgaattatctggaagttccaaagaaagaacacttctccctgaggatttgattgcaaaattctgacttcaaacttctaaaaagatcaaatgttaaatcagatagtaggcttggaaaactctatttctctatgtaaaaagtagagaactacttttcttttgtttgatcattttattttgtttaggaaataagaggattagataccctggtggtgagtggggagggcagggacatttgcacagcatttctggataaattagatccaaataatcaaatcaaagactctcagctcagaaagtaattaaagatctcctcacccacctctttaattttgcaaatgaagacagtgaaactcagagaggttatgaacttgctcaaggtcacacaactgatcctgatatcaaggtccagggcaaagccaagacagctcatagttctcaccagcccagacccaagggagaaaaaaacatcatagtccttggccacggcagcatcatttgcatcccaaacattctttacccaagacttaatgaactcaaaaagaaatcctgagttccaaagggaaataaaatcattctgcgtctgttgaaaaaaaaagcaagctaaagtggaacaataattgaacttgatattaggggaaaggtgcagccatctgcagactgagagaagggtgaaaaaaacaaaatgaaaatgctagtcttgtgttcagacaatgattatgaccatagaacactacctataagttctgtagagctaatttctttcccagtggggttgatattctatgatagattgcatcagcggtgtgattgttttggaccatagaatacgtatacagaattggcttgttgagccttctggtgtcttgaagtgaaaatcatatctctggacatatctgtcaggcctgaagccctaggctactggaaagaaagataccatgacttatccttcctctaaagcttagaagttggagaaaaattctagttcttgggaagctctgcaaagcagggttcgttaagctgatgccacaggtttttgcaaagcccctcagcacagtgtttaagaaaccagtggctctaggttgacctttggggaaggaacacagctcacagtgaatcctggtaagtggaggggagcattgaatcctctgcctgaatgtatccattttatgccaatgaattgagatatggcttcttgccccatctctgccacattcaagtcctgcttggctaaacaatgctcacggatgtgcacgtgtgcagtgggatgcagctttttctaacctctcacaaaatcacgcaaccccttcaccaaactgcttggtggctcttctgtgccctcacagcccttctagtttagcagttagaggaagacaagtgcccaagggctttctcatttttaggtcattgtggaaagaggaacgttggtgatatgtttgcctgcttgggaggaaaataataatgatgatttactcattggtttctatatgctagttgatgtgctgcattctttctcttatcacatttaatccttataccaggtctgtgagttaggtgctattattatcctcattttatagaagagatatatttatattttatatttctatagaagcacagagatgttgaataacttgttcaagccgatgaagtaagaaagagaacctggagtttaattcttggcactcagattccagagctaaaagcttttcagtgaggggattatgtctagagggaatgtccctgatgctctagtctctaaggttgctaagataatcgctaaagaactgcgctctcagcaagtaaagccaggggttggtcaacaggaccacggtgacccagttacatattcttaatccttacaacatcatcaagcagttgctgttttccccactttacaagtgaggaaactgaggtgtagcaagttaggaaacttgtcctgagttttaaactcaagcctacctgccccaaagcctgagctcttttaaattaactgcaactgctgaccagttagattaactaattacttaattaataagataacaacctaacaggctgtaaggtaaaaaagtaatcagatttgttctataggtcccctcccttttcgggaatagctatacaattgtataattttatgcttcccctgggagagtgggtggagccctggctcccagcccatgatggaagggtcttggcagtatttgtaaagcagtctgtgggggtgtaactcagggcggatctgaaaagctggtctttggaaagggaacgaaactgacagtaaacccatgtaagtctgaataatgcttccaaatttctccctggaaccctgatttccaaattttccattctgttttataacccaggtccaaaccacagcagtcccattaatggattccagtgcaaaacaactgctggtgtattcctactacacgcaggtctctgttgtttgccctcatgtgctattttatctaatagctgagaatgacagtaccaatggagcactgagttaaggagtcagactgttcgaaggcttcattcttcgttataattggtgagattttccatgggactaagagaaaattgattaactctctgagcctctattttcctcctctgtagaatgggggaggcagttcctgttcccattttaccacagccggcgtgctgtgaggggatgttggtacatttccaataaggggacaatgagtgtgaagagaaaggaaggccccaggtggtccgtaaactcttccaccagtcccacactataaacagctggttttatcagggggattcttggatgacaagtaagcacttaagtaaatatcaaggggagtctgggcaactgagtttttgtagatcctcgtgtcattgtgttatactggagccaatagtaagctgacatttggaaaaggaataactctgagtgttagaccaggtatgttttaatgaatgttatttgtttccaaacataagccaccatccttagaaattcagtgaaagataaccgaatctcctgcccagttattagcatctttcaccatgggtctttctggagaaaatgacaatgtgggcagcccctgactgcagcccctttgggactgtttctttaacacctttaagtacttgggaatgttcagtgtgtttttgttaatgttggagatatgtgtctgacaaatggaatctgaattgaagttttagtgtgtaggggcagaaagcatttagaaaggacaaaagaaggacagattagactaaaatacataccaatggctgggagtatgcaatgcaacccaatccaaaaggaaacagtgagatgtagcctgctgattaaacaactgagccagcactccgtgtcagctgacttgtcttcccaaagcttccatgttggtgcaattaggaaaagaattgtctaatccccataactcaaaatcttggagccaagctaaattgggtaaagccgtgtaagattttctggtactgacactgactacaagctgatatttagggaaaagttaagattgaaagcaaatattcaaattagtcagaaagaccacgaacttctgaaaacaagccccagggtgctgttaactgctgcatttctaattgggtcctcatggaacattttcatctctgccttgtctgagctttctgcaccagagaagccccttttgatacccactcacttctgagtccctcattgaaaaggtggcaactaagcttagagaaggattccctaatccaaatgcaatacttgggggaatattttgagtattgctccaccattctcaaaacaaacctaatttcagttaacttgaatgtagctgaaattttgttccatgagggaatctctgctttctatgataatgcaagctcatttcaaacaattgtttgggatttaacttttgctcataattcccaaaagataccaactattcaatgagtatcttaaaataaaactacttttatgaccaaattattatccccattagaatggctagaatcagaatgtcctagtatgtattatgtgaaccccatgcgaccttcctaaagtttcttatgcctaaaacagcataagagagaaaagcatttccacgctaacctgtgtgttcactggttaacaaaggtctaaagagcaggtgagtcagctgctccatttccaaactggactggacatttacagtcctgcagatactaaaaatgataatcaggaaaagcacacacaattctactttttcttataattcccatctttcccaaagaactgttataaattctctcccaaaggtgttatattcatccttcttttgttgcctctatttgtgatgtgtactgaggtgaaatatttgttgagattcaaaaaccccatgagatttaacttaagctttccctgtcagagagattctaagagctaaaagatgggaagctggtatttgggaactagattaaaaagaaaatccaaattaatcccaaggagcaaggctcaatagatagttatttagacataacatgtccaccctgcaagcctagttgctcagttgactgggctgcccctatcttagtcttgcctggaagagaaataagttgtttgccccatacctgtcttgagaaatgtcagcctccagacctgaaagcttcttgtgatttggtttatttctgtagagtttattattatacacagtgttcttgaagtaatagagaagtgcattagaagctcctgcaaatggaaatgaaatgtaaatttagattgtaaatacatgactgcggtaaatagatagcaagaaaaaggatgaagagattagaaatttgccacatttctctaaccctaaagggatgtttctataaatagtttaaaactgttgaagacgaagggggaggaggaaggagaacagaggcaaacagattttctcctaatcctttccatttggcaaaattagaaatggtttttcaattaaatttccctgagcagaggaagaaaccatgtctgtttccacactaaaattcctgtgggtgggagtctctagagttgatttggaggatggatccctgttagtgacaagtgctggtaatgctcctgttggggaaaggggatgagtacaaaaataaatccaagtaagtgtggagggacaagaagatctcacagtgcaggatttcccctggattttctgcattgccttttcacctttcctgtcttagcacgacaaattaggtcccagatgagcaggccctcgcattcaaaccggaaattttaaggaggaagccagattaactttactcgggagacctagtagactctgactttaaagattcttttaatccagctgtttttagggagagctctgtaaaagatgaaagaaatgttttaaaaaaaaattaaaattctgtggggtgaaaacaaagatgttaaatatttgattggcaaggcaactggaaaatctggaccatgtctacaactgctaaaggaggctttgtgaaagagaaaatgagcagcccaaggagatcctgtcctaaacttctctggccagtgaaattcgggccattctctgccacagccctggactgctaggagggcagatcatatgtcttcctcagtggggagaggtgggccctcgctggcagtttctgtaaagcctcgtgctgtggtgtaattcagggagcccagaagctggtatttggccaaggaaccaggctgactatcaacccaagtaagtatgacagggtgaagctacatgcagctgagtacagtcttttcctttctagaccgtgtcctgcaagctctccttgagggacgtatactcattttgcattgtcctttgtagagaagcagaccaggaaagacaggaaagccctcaaatttccacttttaaacacctccctgtaaaaactgtctcgcttccctccccttctacaatcagtttctagtaaatcagaatccggtgaattgatatgcaatttcaacgaaaaaaaaagcagagaaatagttaccccaacaagtgcaaaaagtagaaactatctgagtaccagccaagggaagataattaggaaagaaaaaaaaagaaagaaatggattactggaaccatgatggcagcttagtcacaaagaaaatgataaaaaaaaattaaaattaaatttcaaaaactttaaagatatatacatatatatatatctatatatatatgatatattgtcctctggaactccagcactcacctacagcagctgcattctggacttattatcaaataacctataaacctgtagcttaatgaagagttgagcaatcgtgactatattgacccccaggacccttctgcaaagagcagcttctgttcctgtttctgtaaagccttctgtggctgtgagaatagtggaggtagcaactataaactgacatttggaaaaggaactctcttaaccgtgaatccaagtaagtttgaagggagtgggggaagggggaattcaaacacttctgatttaattacttgcccctccaaaacattccagcttaggttccaaatctaatgtttgtgctggggggatatggtgcccatcagagggattagaactccactgtacaaagactaaattactttcagcccaaaacattcctatcattcatcttaaacaagattattggtgcaaggagaaaaactgaatacagaatcctgagggatccagctaagggtcaggaaatgtttgccgaaaagataaagaggaaattggcatatcgtgactacgcaaatgcagtagaccaaatataaattgtcctgacttagatactaacactcctcttaaatttatcgcctgaaataatggaaccctgcaacttcattaactaatgctgaaaattctataagcaggctccttttcttcttttaccttcactttacctctctgaaaagaactgttctcaatccccagtctggtaactgaggtccagtcagttaactgtctggttaactcaggcagagcatttaaccccactttttctttggttaccaaaatagtggattcagcctccactttacttagttcacctgagaaggggaaaattcatctgtcctctgagtcgtgagaatagagcagtacattctctccttcaaatatacacccacccttccctaatggtaatgtgtgagtacttagaaaagtttttaaatgttagatataaaagtaaggcacagtggttgctaatggcacttcttgaaaatctgcgctgctggtggacttctgaaagtggtgcttataaactaaggctggagaagactgacttgtaaaattcagataaaatgaaaatgggaaaaacttatcaaagggccccggtctcctaagtgccctgatgttgagtaaaggccaaatgccccagttttacttactcagatctgctttctgtgattaagaagagatgcacactagagagaggcactttgaaaaacacagcccaggcaaaattcttaaaaagactggctctggtggcggggcgggtggtgaaggactcagggacaccgtgcatgcagcattgagggagttaatgcagacttgctagcagacagcttggaacgttctgggataggccctgcctgaagaacatgcagtgtggttagccatcaagttcccatgtgcagaagtgccttgctcagcaggggcaaaatcagcacgtctgtggcaacagcaacaatgaataatatatgatgttaaatcccaggggttcagcagtctccactgaggtcttatcaaattaaagcttcaaggggattcatatgaacatcccaggagactcaaggactcagtcgcttttcagagggtgggcagccaatgctagggaccagacagtaggcttttttctttggtttcttaccggaagcacactagggcggggctctgcggtgggttttccagaatgcagagaagctgggagcccctctcagcacttggtcagcctcttaggggactgagaactgtaacaactcctaccttttaaaacattgacgaggtcagggtgtttgacagcctaaccaggcaaagaaaatatctgtgcaaggctagcattcttccagagctctggacagtaatcgtatgccagattttccatgcagtggattctagctgcaggaactatatggcaaggctggagtccaaggaacccatgattaaattctgttttcctgcagtaagtggaacacagagattattgccacagcaacactttgggtgcctgtctgtttgaggacctcagctgagggcaggcatctggttttgcttatgtcctgcggaggctgaagagagggtgggaagccctttagacagtgaatactgtgaaatagtgaagagatgggaagggtcgtttgaatccctgactgctgtccttaaaaaaaatggatacgtcttcttagctaaataatagcctttttctctcacccttttcatgatagtaagcaagctaaaactttaaccctttgtaacaagtggttgcttgaagacatgactaaacaggctagcataaattcagcccaaaaaaagtctgagttaagaaaactaaattctattaaagaggtgtctgtttttcacacccctgggggacagggtttgatcatcaccacatcatgaaactgcctggattttgctcttcacattttttgtgacatccagacacagccagggtgactcccaggattcctgtggttgtgtctgttggcaacagaagcattatttggtcaagggatgaaatttacaggaaccccaagtaaatgtgcaaaagcctgcccctaatagagacctcacttaaccctaccactgtggtcaccgggctgctctgtgaggtcagaacacctcaggtgagactgtggagtaaccagatgtcctggttttcctgggtttcaggggttttccaggacaaaggtcattctttgctaagcccagaatgatccccaggatagttaatcaccgtaagaaggcacagataaaaacttttttctgtgagctactacttacatttcaccaaattcaagactgacaaaaaaactacgttgtgtgaaagctcagttacatgtgcccatcatttttatttcttatgctagggcatgaagggaagctcaggagatcctgtttcatgaggctacagtctaaatctcatctaattctagtcattctccaaaaagctgaacactctcctcttgtctccttgtaatcaattcattgtcatcagaaatgtgtgacacctcgaggggaggggaggacgtgtcttgaaaactgatcagagaaattgtcctgaaaatgatgctgtaaaatggaaatgagacctttagaaagagagatgctgaacatgagaaatcagtaagcctcaagacaaaaaccagaggaaatggagagagatgggaggcaggaagccggacctcgggggacgcagcaggtcagtgtcccaggaccagaggtggaaatggtcttccagcctttggtgggatgaaactgagcctcacagacccaggcccctttgggtgagtttattctccccagaattaaaagaggaggaagtctgcgagcttcagaagtccccctagggttcttgtaaaggcctccagtgcagtgctaatgctggtggtactagctatggaaagctgacatttggacaagggaccatcttgactgtccatccaagtaagtgtaacaagacacagcagtatactggaaattctggaatgtcaccccagtgtcaggttttaaagaaccagatattgcttaaagttaagtggtgtcctctgaggtcctttctcttctttaacctcaatattcacagattttcttttggaccctgagttgttaggtctgtctccctgctgcgtgtacagctgaccttgaccctggaaagtcagaatctttcctgctttcagtgtcttctctggaggtgatgccctaacttttttgagggggaggtcatcctttccaaatgactcccctgagtaacctgttctaatgtttagtagcattccctgtcagaagtccttccttacctcaatcttaaattattcttggtatagccgaggccgtttccaccagcatcatccacaataaagaggaaaattgagagcggagtttgaataggtatgtggtatttggttcagaatgggttttaaatgaaagtggagagggaaaaaatgaaacctgaatgggaatctgaggtcttatttcaaatccctctctgtttcctgtctgtcatctccttttgcttctatagatgcaaaactacagagagagaggcggggagagaaaggatagacagaaataaacatccactgtgtccattccctgtcactgaaaccaccaggcaagggattacaattaattccaaagagtttcagatacacggcttaatacctttctccttgtggtgacttgtatcctggctgataattagagcagatagaaagatttggctttggtgtgtttgccgctgcaccccgctgggaagagacagaaacttgactgttttttaagattcataaagttccttctgtcagtcgttgtaaaactccctgaagcagggagatgcgtgacagctatgagaagctgatatttggaaaggagacatgactaactgtgaagccaagcaagctggaaagacctaaactcacagtgttccttatgtacttttgctcccttccccgtttcaggccttttggctgtttcctgtagggattctaagagagtcaaatggaaatggattgaagagagtctgaagccccgtgggtgctcagaaatgataaatgaaaggaataagagacagaaagggaaacaaagttgaaaagcaggaatatgtctttcactgcagcttgataagactgagatgtgaggtgggtgtcagagaagggcatgatcgctccagctgctattgcagaacactctgttttcctaggatctctatcaagggcagtgtcctcttatgccaaagggatgagtcaagtccctatatttctggagtagctgcccttgtgcaggcatagttggtcaggcagacagcacaatcccagctcagtgtgtatggaggaggccacctgacattgccagctgtatctgctccattcagtggcagcataaatccataccaggtgggtgtggatttggaatatgccagtgccactacaaggctgaatgttgagttgttgtgatcatcttgaatgtgtgagatgcctccaagtgaagtctggttctaatgagcagggtgcaggttggaccaatattgcccattttctgttgagtttctccaagcccagtagtgtgggagccaacattgagagactgacatttgagctagggatcctattgactgaaatatgccaaagggatctgaaaggtcaaaactgccttcagagctcagcctttgttgttatctctctggcagttgtcatttcagcaaaatgcatccacttagaaagctcagctcttcattaggcagacaaatgagaacaacatattgaccagagataaggagttgggagcccagatctcagcctctgagagcctggcatttccagttctttaatcacgtgagccagtgagcatatgctatctcagagaaagcagatcaatggtgcctgaggacctggtgtcaccaagctagggcttagagacagaaatgagatgcagatggggatgttgtgtgaattggggaataatagagaagtgaggaggagacagggagttcaatgatgctttttaaaaccagcagcatgtgagaaattgtaatgacacaaaggtgaagaagtatgtattgcatataatcctagcaagtttcctaccattcccaacagaatctagcctcactgtggctccaactcacagatcctataggtaatgctgaatcttacctgagatgccttttgaagtggcatcaagactgggctctaaaatctttaagagtcacctgtcagttattgtaaaggtttggatggctgtgtgaaaacctcctacgacaaggtgatatttgggccagggacaagcttatcagtcattccaagtaagtgtccctggggtgctgcctgtggagtgcgctggggctaacagtctcatacattagggcttaaatgactgtgcagatggcatcgtggttgaggacacaaaactgagagaatcgagatacattgactctgatcagaaaaaaaggtcacggaatagcaaacataggtttagtccttaaaaggtagcatagataacatgggacttgaacgtggcaatttgaaaaacaacctgtggtctatcagcacgttctcactgcacacgggggataaacaggggtgggggaataagcaatggacattgcatgataggggtgctagggaaatgaggcaggtcaggaagaaggaaggtgatcagagcctcatacggagttaatctagagaagatgaattgttccataagtttcacaaagaaataaagtccaaagatataataagaagtcctgattaaaatccacttcagaatcatatgatcatcaggagagaaattaagtcttaaaagaaaaagaagtttttaaatgtaggtccataaaacaaatggacctacacctttaattagacagcaagcagcacaagatgcacgttagccttccttttaatcccctctcaggaggaatcagtccctccagctgcacatggtcacagctgctctaagccctggagctccttcccagtaatacccttgctcctgtgcctgcacagggaaaggagatgcctgcctgcctgcctgcctgcctgcctaccggtctgccttttggtccgccgcttggtggggccccaggtgtaacctctggctgtctcttctgcctggtttttgttgagcttcctatcacagtggaacaccggtaaccagttctattttgggacagggacaagtttgacggtcattccaagtaagtcaaagaaaattttccatcaccattgtgttgagcaaaccctttaaactgcagaaagagctgtcaaagtctgctactctatttctctgcttctaggtataactttatctggaccagagtaaagaggcccccgacccaccccgagaatgatttatgcttggacaggtctttatttcattccttgaactatctatctgtctatctatctatccagctatctatgtatctatctatctatcatctatctcagaaatagttgtttttaacagttgattctgtgcctcacccaaattgtcattaactaaatgcagatgtgctgccacactgataaacttcattggaaaaaaagaaaaaaccaaacccagagaatgttccttgaacattcctgaagtgggggggcaggcgatgtcacttgcagtgacagctggcctctctagctcacccccacatctgtgccaaccagagaagctgggccctttgtagcacaagcctcaggagcagagaatggagggacattctcaactgagaggagagggactaggaggctagatgggaaatgaggtgactctacagaaaatcgaatatgggatggtataaaaggatgagaaagatggcagggggtccacgatcgctcttgtatttagacctgggggatgcactgatagataccacctggagagagaaagaggatttctgtttccctctgaagaaaaatgtggcagaaaaatcaaaacagatcgcacatgtcaagcctctcctaattacagcctttcattctggtttctctcagctgttccagcaggaaatggtaggaaagggtcattggtgcctttgatgttgtggaagcattgcaggaaggagatttgcaagaaacggggcaggggcttgcagtagagtctggagagtttagaatgatggtttttgcaatgacttagaacactgtgtatctaactttggaaatgagaaattaacctttgggactggaacaagactcaccatcatacccagtaagttcttcatccttggtcaggaaatcagcctgcataagattctggggatcatagtagagatgcaggcttagagaattttcatctgtccttgttcataactggtagagacaggtggcagccaaatatctgagttttccgggggaactccagtcctgactatttaattcaaaactagaaaatatgattcacaattctgtttttgctgctgccgtcaagtgctaatgtggcatgtgaagagaattcaggcagaatgactgcatcttcactttcatcttgtgtgataattttagctttgagtactgcaagtgtttgggagaaatggtagaaacatagaatatcaaagagacaagcaaaccaagagacccagagaggcaggcagacggaacgtcaggcagtataattttacaaaactaattcagtgttgtgtctctctctgcaaatggcaaggtatcgggaaaggtgctaagagctagtgctccgggtggggcaggattatctaaatagaaaactaagcactgatctcagggggaaagtttaaacttggaaatctctgggtttggttttttgtttttttccaatgaagtttatcagtgtggcagcacatctgcatttaattaatgacaatttgggtgaggcacagaattaactgttaaaaacaactatttctatgcagccataaaaaatgatgagttcatgtcctttgtagggacatggatgaaactagaaatcatcattctcagtaaactatcgcaagaacaaaaaaccaaacaccgcatattctcactcataggtgggaattgaacaatgagatcacatggacacaggaaggggaacatcacactctggggactgttgcggggtggggggagtggggagggatagcattgggagatatacctaatgctaaatgacgagttagtgggtgcagcacaccagcatggcacatgtatacatatgtaactaacctgcacaatgtgcataagtaccctaaaacttaaagtataataataaaaaaaaacaactatttctgagatagataaatgatagagagagggagatactggatatatatacacagttaatgacaatttgggtgaggcacggaattaactgttaaaaacaactatttctgagatagagagaaagagagagatactggatatatatacacagggtagaagaatgtagagagaaacatgggcaaatatattcttttgcacctacaattaaaagctgtggaaaatttgaatatgttcactttgtaaccaaagacaaccacacaaaatggaacggaaagcatgcttgcaacagcgagaactggaagtatggaacctttctgtcttaaccactcagttgcctagaagaatcttttttctattttgctgcattagaaattaaaggcatgagtattgaggatttgggtaggtcagacttttatagtgacaatcacattacaaagcacctcttagctaggttggataaagcacctttaaacatcaaagtctttttcttctttctggatgagatagaaaaatggtctctcctcactctgtatctaaggacagggggctcagagagttccagacttacaaagtgagactgcagcagagctgagccatgggacctggagggacccagtgacggttagtctgctccctcccacgggtgctatagtagccacaaccgttcaggaaaccgtccccaggtgagaacgtaacacacgcagggaaaatcccactgctactaagagcaactcagcataagaatgcattacccagcaagggacagtcagaggggctctaaaccagagccccaaatatttgaaaactttatgtggaagccagctataacaagttcgttttccaagccgtgcttccagaagctgttagtggttggtagttgctaagggttttgaaactggaggacatcatagcagagtggaattatttggcacaaggggctatgattagaattaatgagatgaaagaaaattctggctagaagactagaaaaatccggaaagaaaagatacagtaaaccttgggggagttgtagcatttatcctagtccaagcagcaaagagcagacagaagccaaattccaataaacaattggcctttttacttttacaagtttctgcaattatcacaatgtcttcagcttcttgggcaaatatcaacaggtcctaaatgcaaagtggaacagtcctctgtttccagaaccgagtagcttagccccgccccacacaccacccatgctcaaccactgtttttgtagaggagtttgacgctgtgtggaatatggaaacaaactggtctttggcgcaggaaccattctgagagtcaagtcctgtgagtataaaacacactcaagtcccaacctgggtttcattgcatattaaataaactttttctggctgggaagtatttgattctaaagaaaggaaaagtgaaattccaagcgcaacgcaagcatttcattagtgtgattcattaagaatttccatgggttgccttcgagagcgttaatcacatccattcactggtgagacccacagtttgaaaattgagttaaatttgaaaaaaaaattgtcaccatctctgtagaccacagtgcttgctgtttgggtgtctagacttccaaaatggaacctcaatctgtagtttcgagcttggagatttatcccgagcccgtgacttagagatgtgtaagaaaagctgcacactgctgggccttgtagggcatttgtgggatcagtgtcatgaaatagcctgggtagacaggttggtgaggagacactggtgacaggtgtctgccctgtttctgtaaagctgctgacagccgtgagaagaaaagcagcggagacaagctgacttttgggaccgggactcgtttagcagttaggcccagtaagtctgagcagaaagtaagatatttatgccttttcctattatttgttctagcctgacatttgagttgtcctcctttggattccagatcaacaaaccatagtgtcttttcatactccttttaatatttgtggctaagggccctccgttcttcccatctgtcctacatgagggtcctgtggccaggtccacattcataaagaagccaacagtgatgcagttggttggcagtgtgtcaagaaactgcagtcatcatctccagggcccttactctggttatgtgtgtttcaagcttttatgccagcaacagaggagagggagaagtgaccagtagcaatgaccagggctattagctgtacctggtgtctgtgggtttcagagcagctgtggaggttacgggaggttcagggcatgagtttttctggcagaggagtttatgtaaagggttggcccagagtgtgtattcaggaggaggtgctgacggactcacctttggcaaagggactcatctaatcatccagccctgtaagtgcttttgcctgggaggtggggttcaaaatgcagtcctcatggggacatttctaaaccttggctcatgtgcttctggtgccactaccatttttggcactatcctacttacatgggaggttttgagccatgtagacaaggaggtgatgcagtttgtgctttggaggactcctgagatctgccctttggcaactgtgtttgagtaggagtccctcattggaaaatctggatgccagcagacaaaagatatgagcttaggatgggtcacaaacaaatggaggccactttgccagcagcacctttgcaacgaaaattgctttcataggaaatgtggaaatggctgtgtagatagagatttggccatttctccttttctgtctttataccctcttctctgcctgacttagggaccttaaattagagcagttattaatcatttgatttctcggccccatcactcatcaagtatgacaagagggattcattaagataaaacccagaaacagaaaggacaaagaattcaattctcaatgtcttcagagttgaacttgacaactcctcagccttaaccatctagtcagcaccccatgaccaactgaggtcaaagagggcaaccagcaggtaatgttagtcaagtgagtatctggccagagcccagctgccctcataggaattaatactgtggagtttgggaaagggaaatgcatctgtgagggctcacccaggctgcccatctgggagagatcatggggagagttctgagtgagggagtgaacaccagatggaaagtcaagcaacaggtttctgttatgaagcatctcacagtgtaaataccggcactgccagtaaactcacctttgggactggaacaagacttcaggtcacgctcggtaggtaacagaaaccgtgaggtaacttaactgtgtgttcctttaaaacaggggatactgcagaggggatatcctggctggatgtagtccttccttccttccagtgggaggtgatctcactgaggacacatacctgcattcagtcagttcttgtgctatttttatacctgttacggaggctttcctttccacctgtgaaaacagaacctctctgctccaagcttcttcagtctttattaccctatgtatttcctttagaacagtggtttgggaattaatttatcatcaggactttgtctctgatgatatcactctgggcaacaaaatgaaagggctctcaaatagagaacagagagtcctgaatactcggataacttttccagagtgatatgtgttatgcgtaatgggatgaagtgggctagaatgaccttccaatgactattttggagacacactaaggaaacttgcttaacatcctatatccttaacttgttagaacattggtgaagtaaagcaaaatcttgaccctctaagaacataaacaaatgccaactcctctcccccaaagcactgccatgtttcattatgtgcaattatgaaacaaatacatgataatttatatgaaattacatagatgagtagtttgagtattttgacccatgagtaagatgcaaattgtagaagttctcaggtagttcttcataaaaagttgtccctgaagacaaatagtgtacctgggcataatttgtttgcagtgttggtttatgcaccatttggggacctgtttgaaagctgattatgtcccagtgtgccaatttggggtctcaattaactgtgctcagtgcactgataagtgcccatatttacagtctagaagcatgacaaaatgaccccatttctgtaggaaaaggagaatggaactgtgtgtggcgtggtacttgtcagtgctgctcccccttgtccctgccatgctgggaggtggctgcaagttttccccaggaggtttttgttagagcatgtattactgtgacaataacaatgacatgcgctttggagcagggaccagactgacagtaaaaccaagtaagttgggggaatgggtcaatcttaaaagctgacctgagtgagcaatggtgctgttctgggcagtttctgtggggttaagacactgccactcccaagaggatctaagtacctggtttctttgtgcctgagaccctgagctggttggaagtctgttagttgatgaattctggcaatcttaaggattaggtcaagaagaagtagaaaatttcactggtttcttcattggcttggctctggatatataaaaatgctaaatataagccgggtgcggtagctcactcctgtaatcccagcactttgggaggccgaggcgggaagatcatgaggtcaagagatgcagaccatcctggccaacatggtgaaaccccatctctactaaaaatacaaaaaattagctgggcatggtggcatgcgccggtagtcccagctactcaggaggctgaggcaggagaatcgcttgaacccggaaggcggaggttgccgtgggccgagatcgtgccactgcactccagcctggcgacagagcgagactacatctcaaaaaaagaaagaaaaagaaatatggctgagaaagtggcatggtgctcctggtccctaaagtagcccctgggacctcaatgttgacctcctgtgctgggtgggatgtttctgcccaaccttgctattgtgcctctggcacaagcattctgtcagaacccagtgtcctaggaacaaaacaggggatttacgatcaagttcagatctatctgcacagccagctgttaattttagagaactgtcctgaccttgcaaaggaactggaaacagaggctgcaaggtggggagacttccactagaggggaaggtgatctcacttgctcagccttcccctccatccttcccacctgttgattattgtaaagccccataggactgtgtgaattatggaggaagccaaggaaatctcatctttggaaaaggcactaaactctctgttaaaccaagtaagtgttggggattcaaagtcctgatttatcatcagtactttgtcactctgggcaacagaatgaaagggctctcaaatagagaacagagagtcctgaatactcagataacttttccagagtgatatgtgttatgtgtaatgggatgaagtgggctagaatgaccttccaatgactgttttggagacacactaaggaaacttgcttaacatcctatacccttaacttgttagaacattggtgaagtgaaaacaaaagcagtaagtgcaactaaagtgcaatgcagagtgagtgagaagagacttaccaactcctttctctgtgatatcttccccccaccttcacccttgaaccccacagaattgtttctgtccatgcccctggctgttcccagtccagaccagcacgtcgttctgctggacataggaaaactccagacttcataacatgtcacagggccccctccctcagatggcagatctcaatattgatcacccacatcactgtggggagtggtgaccttgtcagcaatggtctcatggaagagggaagctttatttacaccatcaagggcccatggatgacccacagtctgtgtgactgctgtgtgattggttttcagacattagctttaataggaatcataggagaagggacatggtggctactgcaaggggttttttgtttagggagaacgcactgtggaactcaaattccgggtatgcactcaacttcggcaaaggcacctcgctgttggtcacaccccgtgagtttttgtggtttactaattgtcctctctggaaagaaatccaatgggacctgttgaaacacagctgaatttaattgctatgcttagcatgcagttgttaactatgtctgatgtgtgagcaagatatgaatacatgtttccctggaggctggatttggttatcaggtctcggggcagtttgataaattgtactaatgctgcaatcactgtttttcaaaggtccacaaagcacgttgtggctttgggaaaggcagagataagaagcaaagctttgtgatagagacagaaacaaggccatgaaaagggaagctaccaaagcaatggcatagccaaggaagtgtgtcctcaacagataagtggcaaggaccctgttgagttgatgcttgtgttgtctggtagaattaaaaaataagatgagtgggctgggcacagtggctcatgcctgtaattctatcactttgggaggctgaggcaggtggatagcttgaggtcaagagttcaagaccagcctgatcaacataatgaaaccccatctctactaaaaatacaaaaattagccgggcgtggtggcgggcacctgtaattccagctacttgggaagctaaggcaagagaatctcttgaacccgggaggcagagattgcagtgagcctagatcgtggcactgcattccagcctgggtgatagagcgagactccgtctcaaaaacaaaaagaaagaaaaacagaaaaataaggcgagtggactgaggactccagtgaagggagggcagcaggagttccaagcttggcatggctttcttcctctacgagaatagcagaacaatgtaactttctctagagagagaacagagcccttgatttatcacatcaatgcttctgtttaggtagcccccttcctcaccgtagggacaaagcaggcccccacatggacttcacccccttaactaggctggccaagccaaccctatgggagaggcagagaatcccaggactgcagagggcctccccatgtccactagattatctgtaataaaacagaatatttatccaagttgtgaagctgtgagggagagggtaatcgtgatagattataaaaagcaatattgaaaattatacaagctgtctccacacttgcagaattcagtgtgttttttgttgttattgggtttttttctgttagaattacagaaacaggggtgctttcctgcaggcaccctgtttgcaaaaatgtctgccatctcacatttcagtagtatttcatcaacaatcttctgcacacgaaccagctgtgacaataaggtaatggggctgatttgttaacaaatcgagtttatacatttcaatgagtggcctagtcaaaacactcagcttgaagcatccaacactgtccattgctttccccctccctgaaaccaccctcaaaggccaaaacactttctttttgtagcatccatgatggctttatcttttaaaggtggattttactcttgataatcaaaatcctttcagaaccaaggctattaaatagaggagagaatcgactagttactgatactgttttggatccaaaaatagatgtaactataaaataatgtcatgggtttgtttatgtggctcataaactggctctcggggggaatcctagatggaatatttcagagggttcaacagtcatttagatgcttaagtcctcatatgttcactaaatcagactctttaattaataaacatgcataaagatagcatgagattgaagaacttttgcaaactcggacccaatagaagcagtgaagactttctgtatgaattaagatataatccgaaataaattacttgtagaaaaatacgaggtcaaggcctttcaatggggaaagtgcatgtaatgccccttttattcatggagagtaaagctgcttccataaatggtaacattatgttggtttatgtagagacacataacactgtgactacctcaggaacctacaaatacatctttggaacaggcaccaggctgaaggttttagcaagtgagtattacagacaagacaggctgtattttaaaggttgttggtgttcatgtttgagggacaagggaaggtaggacaagggaaatacccatgtaaactgtgcaagctaaaatcactgctatctgaagcggcaattctgggtccctctactctggacaggaggggcgaaggagagctctgaggcttaccatgatggacttactgccgatttcataagaattgtatccatcattagcaaaatgtttatgacttgaaggcctcaagaaactcctgttaacacaacaggagttctgtgttctttattcttttaaaactatattctcactttacatttttcactcatttttctgcctttttttatgcgtctctcctctgtgcaactcaatgcttcatctgggcattcatattttgagaaatcatctcaagaggaaatcatgtccagatcctagcatgtcactcaaagctctctgaaatctgggccctttctattctccaaatttattcccactgattccctttcatgaatgctctgctccaggaaaactaggtatctccctcccttgaatatttacacatgcccacacctgtaccctgtgtccatacatcagacatcctggacccaccacctaaaacaggcttgcacaggtgacaaaatttggcctcatcatctctcagccttgagacccagcacaggcatcaccagatttagtttcataggaagagcatgaaaaatcatatcattttttaattaagcaggccaaggtaagagatccatcagacaaagaagcaaagtaggaaggagagagatggcttctgtaatgggtttgcaaaggagagctctgtccctgaaatagcactaatataatccaagtaggagatttacaggctgcatgtttcttggtttccctttggagtgctccattcctaacaccagttgttaagcccctggtcctgaatgtggccgggggtgaggaagtgggaggagaccatgctggccactcagtggtggtgcccatggagtttcgggctcagactttctgtgagatacctcaaaattgagagaagctcaaaaggatcatgcagcaaaaatgggagaagtcaccttcttagtcataagaggattatttctgattagtccttgagctgtgttatgtcctggggaagggacagtaagagtagaaaagtctctcctaggacaaggataggaagtggtgaaaagtccttttcctggtgactagcaaagcaggggatgaaaagatctggagttggagtccagggtggattccagggcagacaactgcataggactgtctcgagttctgtggattgaaaaggttgggcatcccttcagatgttcctgagctgacctcagtcagaggtgcgtggctccagcacccagaaggtgtgaccagcacaccaacccctcctcccaggtgggccgtgacagcttccctcaatccctcccactctgacaacagtctctctgattgcttttgctttggtgctctggacataaactgttcctactttgtccaagtgaggtatataattttcagaacgctggagaattattatctaaaacaccagtggatacgctacaattttggcattcagtattctgggcttgtgcaggaaaactctttctttagaacatgtagaaagactatcctttagttatccagtgtggaaacagtcctgaaatccaaactgatactgcgatcctgtgccaggttattactgtgacaattacttaatattctctgtgctcacgatatcactccttccagaagatctttagggaaaacttagttcagtttctaggaggtttttgctcagccgaagatcactgtgtgaataataatgcaggcaacatgctcacctttggagggggaacaaggttaatggtcaaaccccgtgagtatctctgctgaatccataatgaatgctctaatttcaaaaggaagccgtagcactgagctctgttttctgttttctctacttaattttatcttttatattaattctaatggttacatgttatcgatacatggcatatgtatatatgaaaatggacatacatgtaactgtctggcgtgggaacaaatgtgctggagaaaaacagatttcttgtcctttttgtcttaaccatttgggtcagaaggtctgactgagtagaacatgggctgggtgagcactgcagtgggggaatccttctccagcagctttgtcagaattatgctctttgctggcctggtcagaaggcagctttgtcaggaggtggaaggatgaactagttaacctcagaagagcctttccactccgaccatgctgggaatagaccgccataataaacagtcttttccgctgcctctttagccaacgtcccagctggaggagcacgccggccagatttggggattgaaagggatttcctgatacacattggcctggtcggttttggtaaagctttctatgactgtgtaatgctggcaacaaccgtaagctgatttggggattgggaacaagcctggcagtaaatccgagtgagtcttcgtgttaactctgtcaaacctgtctgtgcagtttgaaatatctcagaaactgcctccttcttttttagccctgaggtttaagatatctagttatggctagtgttttcttcctgtccaccaaagctgaacccttgcctacccctcaatcaaaataactagatagagggatccatatgagcagggtaggaaggccattggagtgttcagctgttttcttagagagcaaatacattcgtgcattccaaaaaggcctgtgtgggagcactgaatattacagaaggtgagtgtgtagcacatttcatggccgctttagtctgcactatgccaacctcaccgtgggccattggtaaatactgttgctttctggccaaagacaggtcaagtgctgggaactctcgggactcacagtcacgctagtgaccgtgctagagcacatctccccactgtggattatccagaatgactcaaacttgcgatataactcctgcatctctcagttctctttggcttagagccttattgtggatttgctagaggtaacaggaaaggaactgatttcatcctaattctagcctcttctgagaagttattctctgcaagagtcttcaggagcatcttacagaccacctacactattcagaattttgttccgcacaccacattgtgttcccagcagtgtttgctgtggctttggctggggccaggtcctgagtcagttctggagctccaggcttggcaaagctggataagggcaaggggagttgtacagcagaaccaaagggcttcaggaaagacatctttgatatagacattaatgaatttctaaatgggcttctatatgctaacctgataagactctctggggagaaggtcatgctttcctttgcagctctaaatataagacacatgcagaaaaaaaaaaagaatgggaaatgtctgttacagtgccaaaatgaagataatcagtataaatattagatttgtcttaatattaagtttatgaaatgtaagtctttcagaagaactatctcaggatatatttattaggtcaatgaaatattttatccatgtgactggtatacacacttcaaaggagaacccaaaatggcaggcaggggagggtggctaatgaaaggtatggcatagtagttaagaatatgaattttggaataaaactgtttgggtaaatcctaattcagaaggttacttaatctctttatgcctcttttttctcatctgtaaaatggggatggtaatagtacctagctcactgagatgttacgagatttaaagagctaatacctataatggactttgcataatggcagcccgattgaaagttttcagttaatatgtttttattgctactatgtcaggttgctggagggaaggaagaaaaatggaaatgatccccatttatagtttttgtaaagtacagcattagagtgtggctctagcaacacaggcaaactaatctttgggcaagggacaactttacaagtaaaaccaggtaggtctggatgtttctaagtgaagtgcagttatccactctgttcgttttttgtttaatcttctctgtctcaacttctaaccaaaaactcttactcttaggttatattttccttttataaaagtaagtagaatgtgtgtaaagtctggttgatatgatcctttctaactcacttggtttcagctagtggcaaaaagaagggtgtattggatctggaattcttaggttaaggctgagagaatgtgagtttggctgacttggaagaaataaaaacatcaaatgtgggtggttcacacaaaagaaggtgatttttcataataatatactaaagtagaatccacccttgtgaccaccagaattattcaagtacagtcttccaaggacaaaatgggtagcatggaaatgatatgtttttttggggggaaaaaacatggggagagagagagaaaggggactattagttgtctggattgttaggaaacatggaagacagcacttcttgttgtaaggtttggcaaaggttatcaccaagtagaagtccaaatgtgtgtaacatacccctggcaaacgttatagaagaaggaagctggggccgggcacggtggctcacgcctgtaatcccagcactttgggaggccgaggcgggtggatcacgaggtcaggagttcgagaccatcctggctaacacagtgaaaccccgtctctactaaaaaaaaatacaaaaaattagccaggcgtggcgggcgcctgtagtcccaactactacagaggctgaggcaggagaatggcgtgaacctgggaggtggagtttgtgccactgctgagatcgcgccactgcactccagcgtgcgcgacagagtgagactccatctcaaaaaaagaagaaggaagctgggagcagtgtctctcacctgtaatctcagcattttggaaggctgaggcaggaggatcacttgaggccaggagttcaagaccaccctgggcaacacagtgagacccccatctctacaaaaaataaataaataaaatttttttaaaaatagccaggcatggtagcatgcacctgtcatcctagctactgaagaggttgaggcaggaggatcacttgtgcccaggaggtcaaggttacagtgagccaagaacacaccactgcactccagcctggacaacaaagtaagatcctgtctctaaaaatatatatttaaaaatataaaataaataagttaaagaaggaggaaggagatgaagaaaatttggcttagtaggaaagcgtttttgtactgggcagaaacactgtgtcaaactggggcaaacaacctcttctttgggactggaacgagactcaccgttattccctgtaagtccttacctcttgacaaaaaagctcttagtctgtaatgacaagttctcacatcccagacacctaatgaatttctaaatgagcttccatgtgttaaactgataaaactctctagggagaaggtcacccttacctttgcggctctaaatgtaagacatgttgtaagaaaaattgggaactgttaattgcagtgccaaaatgaagacagtgattacaaatattgggctagttttaatgttagatttataaaatataagcctttccaaagaaccatctcagggtgcatttattagtttgtgtctatacagcccaattgtccagttactttgattaatgttggtagctgatgcagatatttagggacttccttgagaaaacttctttgtgctcaaaattgcatgaattgaatggcacattacctaaataattgccaaatctgtttcactttgtgctgtatagactcagcctaataaaaacaaatgctgttgtgctttttcccagtctgtctcctctccacacagaaagtttccctttctactaaacagcatctcttcacacgaagaaaagatgcccagcaagccatttgacttattgctgctgctagtttgcatttatatgactcctttccttagaagggatgaagacactttatacgacttattagctaaacagattgacagcctaattaggaagagagaaacagattctgagtatctttttgtggctgctgttcctaccccctcgtgtagaacatttggtcagatggctctttgagacagaaataagacagggacgtggtctctgcttgtagtgtgggacgtctcagctgcacctaagaggttgtcacaggagtactaaataggtcagggcaactgacacagccaggaaaatttctttcccctagaacttgtgtgtgctcaccaagcaaagcgtgactaattttgacatccattgttagtgtgtgtctacccttcttgcctttgttttcagacccttcctctctagatccttttccttccatctccaactcctgtatgtaaatccctgctctctcctttgaattcctgactgctatgcccatgcccagcaccggcacccccacgcacactgctgcctgcctctgtaaccatcagctgtatttctgaggactttcctagctccttgagtgatcctcaaatggctcagggccctgagggaatctttgctgagggttggccccagcagagccgctgcagaggtagaggtggccaccaagggacacagactgcctgcatgaaggctggagctgggcccaggatgaggaaaagcctcaggaaggaggggctgacacgaaataaggaataccatggcattcatgagatgtgcgtctgaatcctctctcttgcctgagaagctttagcttccaccttgagacacaaaacatgtggttatgaagagatgacaaggtttttgtaaaagaatgagccattgtggataggctttgggaatgtgctgcattgcgggtccggcactcaagtgattgttttaccacgtaagtatatcttttctcatttctgtgggctgttatgtccgtaaatcatatagaacagttcttcttatgcacacacacacacacacacccattttccagtcactgaggagaaacagtctctgggtctacctacacagccagtttgaccattaagatggtcaaattcatttttcaagataattttaactggttccatttaatgctgccaacagccaagggcattagcatgtcgtgggaacctaatctatgttcactcactgctgtgggaggacagtcatttcttcttctcccctggcagtcagacttcagaatccagctgaccttttccatgcctgtctcttctggcagattaagtggttatttccactaactttcttgtggaaaaacacacaagacagatatattctccttcagtttttactaagaaagttttgtggttatcattttgacaataaacttcagctagcatagtccctactattcatgttaataatatcttgacttgaaccatcatattttccccacatcattcacaatgcatttcaatgctgtaacccactgcaccatccccagcccttttatcttcacaacgttctctaataaggtaaacaggatcatacatcatcaaacatatgtcacagacagaaaagctgacacacagacaagttaaataatttaagtcaaaccaaaaaaaaatcataactgggattagagcttgagattccctattttcttacagtgaactgtcttgagctgtcacttaatgcattgaaaacataataagcacaggccataggcattttcagaacatgaaacttgactgaaacaaaaactgactgtttgattgctttggtgttttaaatgtatccccaaatctcctttgctattgatagtcatttggtgccagtgacagggaagagcagaggggcttaggaggtttttgtagatctcagtatcactgtgtcttataacaccgacaagctcatctttgggactgggaccagattacaagtctttccaagtaagtactagaaaccaaggagccattttgaaaaggtgttttctttttctttttcttttttttttaaatgaagttttgctctttgttgcgcaggctggagtgcagtggcatgatctcggctcactacaacctccacctcccgggttcaagcgattctcctgtctcagcctcccgagtagctgggattacaggcacctaccaccacgcctggctaatttttgtatttttagtagaaacagtgtttcaccatgttggccaggctggtcttgaactcctgacctcaagtgatctgcctgcctcggcctgccaaagattacaggccactgcgcccagccttaaaaggtgttttctataaacaggaacgttctcacagcactgcaggccacccttaccaactccgagctctgtaggggcctttagcacctatagctgcagaaccttctataaaccaattaatctatatgtgaacaatttaacctatatgtgaacaccatggtactgagtaaaatcttaccagcagtgaaaagaaggcactagagcgtcagatgcattatgactctaaacaaatgatctgtttccctcttttgcatttttatttaaaatatcagggaaggtgaagcaagttcaacttctccaatttgaaaactgtttctgaattatgcttcccttgtatgcagagagacctagattgactttggatgtttagtcattcgatttaatcaaatgtaattaaatgagcaaataatctccaatagccaatattcctatgttgtttcattgttttatgtgctttgctctagactttttgtctgggctttgtctctaataggatccccggaaggacagtgaaggtttttgttaaggtttttgtgtctgtgtggatagcaactatcagttaatctggggcgctgggaccaagctaattataaagccaggtaagtctcagagatgtgactgcacgggagaggagacactagttgaataatgcacaaagtgtagcatgcagattatatttttaagaacaagtcagcctgctggagacaatgcactcaacccaaatggggtctccactcccagtgagaagcatgtcagccgctaactcttttgtttggtctagtagcttccggaatgaataatgcttaagtagccctctaagagagcagagccaggttgttagggaatatctaattccctctgatatggttaaaactctttgccaagggcagaaccagcctcattccattggaagagcaaattcagagaaaaaggaaagggtcacacagccaaagacggtaaaatgttcaaaggtgaaaaatagccaagtctgcagctctcctgacatccttgcctcaggctgctgtcccacgtggagagcagatgcctgcaaagctctcggtcacttgctggagtcactcagggttctgggccttgggatgtaacttaaatgacagtgtcagggcactgtcagaggaatatgaaggctgcagcgatgcctgcaagtcagcttttgctacactgggactgaggtgttctaagcctggaaagacacaaagctgtcctcatcccaacctgccgtgcccctccttgagggttagtgtaaggctctgaaggactgtgtgaattatggtggtgctacaaacaagctcatctttggaactggcactctgcttgctgtccagccaagtacgtaagtagtggcatgtgtcaggtggattctgtgtccatggcaagtaggaagcgacagccacccttaggtggaaaggatggctgaaggttgactttgttcactgctgtcatctcttatctgccgtgatatagcaggctgtcaaaattcccattctcctggatggcacaccacagtcaggggaggggaaacatgctaattttatgataaaccccaggggagaaaaagactactgtgggaaaatttagttgagaaaatcaaattgttctcaactaaatgctgcaggctttatgcttctgtgaacccagtttcccagttattcattgaccctgaacatacgtttacctgtgcaaatacaatctctcctaacctatttatacaattatgtgtctgccggtccaaatgccttcttctataggccatgtttttatttctcttccaaaagagactccagagccatccttgggaagagtgctgagaagtcaggcaggcctaactcccaggggtcagggaggggaaagagaaggctaagggtaacttagctcagtactagaactgtgatccacgtatctgtcactctatttcctacgtttgcttcccttttgttttctctagaataagttctttttgtttgctctggacacccactgctcccaggatgaaaggagagaaatgagatcagttttgaacacttcctcttgaaatataaagaatcaacaagttacagtcatgttggggacttcttctctctccaagcttaaatttctattacgtaagccttacttttaaccaagaaagttagtgacatggtatcactgtctgggatgctcacccctctctcttttctccagatactccgtgtatactaaagctcagccaatgctcagctttgtgataaaggagctgttgtgtgtctttatctctgcctttaggatacagtcttttttataacagaaagtgttcacttctcccatttatttcatggctggactctctaccccttcctggctgaaacagcatatgggtccatggtggaacttctttgggaaaaaaaaaaaatagaactgtttgacttttgccactcttccctcatgaaatgttttttaggctatcaaataagcattattacacattgagaaggctttgaaaaaacttgatcactgagtctggaggtgagctgggatggctctgtagctggaaaatatccctgtgggtgtaggaatgtaccgtcccttcaaacttgtgtgtttagggctgagctcacacatacgacagcaagagttgttaacaaattagattcagctttggcagttttatgcctagaaatgcaaaagaattttaaaagctcataagtttggcatttttaaaggagacattgtttgctttatgttgcagagccaatttttcttcctatcataaaaggccagaaacacagagaaagcaaaaaaaaaaaaggaaaaaaaaaaaaaacacaaggagagtctaactgccccctcaccacagtgctatgtgtttggtagggttttactatgggtttcagtaaaggcaggaagtgctgtgggaataacaatgccagactcatgtttggagatggaactcagctggtggtgaagcccagtaagtggccatgttttattgatatttgaccaaacaaataaatcccgtgaagttagtggagatttaatttaatatgtaaacaaatctacttcttgaaaaatgacttttgtgaatacatgaaacactcgtgattattgagactagagcaataatgataaataaaggcaaaatgagaccaccccaaatcacctttaacattgtggcttagccctctttcttctagagagatatggggccatgagctatttacagccgcagtatctcttaaactatgttctgcaatgacttgtgtgtttactctgattttagccacagaatttgttttccattctattaaaaatgagaatctatctcattttaaatgctactaatatttataaggtaccttctttgtctcttgtacctgcatatatattcatttcaaaaagatctcataagaaacccaaacattgtcgcattttgacaaatgtccacatctagtcccgtaatgtcaaatttcactaaaaacacagcctgactatgcaaatgcagtggaagaaaaaaacaattcagaaatggattgacactcccaggtggctttataaacacctaaaaggaaatccagagtgaaataaaatggcaggtatgataacacgatttttttttaatgatcaattcctccatggggaataaaagtttttaaacttacctccttgaaaaggagggaaataggagttcaggagcctggcattcccaggtgtgctcctggggtgtctgtttctccacattgccattttggagacaataggacccatccaaatgtccaaccaaaaaactaatattaagaggctggagtcaccacattgactgtctgttattaaaccctataacaggttataattaagattatggaatgactaacccaaggagctttaaaataggatagcctagttttaaacggttcagccttgggaaatgctggaagacaaggaaatgagatagatgactccataggtttgttttacgtctggtgaacatatccatcccatgttaattttttttaacgactatgataaagagcttctttggggtcaggtagaacccaaaggaggaagagaaaatgggacttggttctttaagtgtcaaacaaggatccagccagggttgagggcaatggcataaggcttccctctcttggtggtgagagaccacatccatggactgtggaaggagaacattttctaaaagacggggatcccttgggctaaaatgaatgatgctcatgacccccagctagggcagggctataatgagtacagcaaacataaggcaaggtatcctcagaatttggtgacagggcaaattctagaacttaaggcttagagccagggtgaagggaagactctgtaatgcagttccttctcaggtggaaatccagatatgtgccctaagtgacctattcctgccccatttttgtttgggctctgaaaagtggattcctagctcagtggctgtctgccaggtatcttttgccttcagtaacagaattatgtttgatattggaaaggagtttgttgtattgttggctttataattcactctcagtgtcaaatgaggtcattcaacttcctctcgcacatttgcaataagcagcatgaaattcaagcagaacaactagaagacacagagaaagatggctgagctgataatgaggcctgtttattacaggagaagagacaatataggaatctgttaagtcccatgaggttgaaatatccaccaaaaaatatgcagctgtcccccaaaaaaaagtcactaggagtttttgttatggtcccaatcacagtgtgaacagagatgacaagatcatctttggaaaagggacacgacttcatattctccccagtaagtgctgtttatgtgattttctgacattaactcccactgagttcaaactgctgagagtgttcagtaggaaagtttctaagacatgtgggtggcctgtaggtcctgggctcttctcttgcagaggtccagtcctcagcctttccacagctgagccaaataccaaattctcccctccagggctggaaaagttgctaccagtcctctgctacccaaatataaattatttttttattgtttattaagaagagtaaaagaatcgtgacactttgtccagaacctattttccagtcttttcccccaggcttgtccctggtaacctctgtttggactcattgttaagcccagcgtgatttttggctccaactaaattgattttggaaatgactccagcatacctatgacccctctccttccaccctccataaaagatttatttttctttatttggcctctgctgagattcctggctttgatgccccaggatctctcatttcccttgttccagggataagtgagagatgactttttaaagagctactttcatcttagagacaacaaagagagtatgccagcaagagcaacatcttgcattgagccttctcactctatgccattttccaaatctttttctttatttaggataagtgaccactcctttttatttctagtacagcaaagagtacatcatgatgtcagaaacagggatttcctttggaatgtttttcacaggctaacaataagctagaagtctgcaagcaattcagaaatgcatccctgagctacaactccatgtatggaagctcatcagcagggtagacaggcaaagcagaaacattttaattataccatactttgtagagattgggggagaagtgggcaaatgcgtgctaaggaaaaacaaaaactatggttaagtggggagatttctagatggttctaacagggaagaagaccaacaagaggaaacttccaggaaaaccaccaaggccaggcattcagggtttttgttatggaggaaatcactgtgggaattcaggaaacacacctcttgtctttggaaagggcacaagactttctgtgattgcaagtaagtgtttctagccatccttgattttgatcagcaatggcttcttcccttgaattatttttcagtgtacctagaatgcttttgcccccaagaaaggtttggaaggagctgggtcattagcattgcgcaggaaaattacaggttattctgttataattcgaaagccaactggacagtcatgaatgcacacagatctgggccctgcattgcaccctggcctagttgcctccagcttgttctgaccgtaatcctggcccagtttcctcctctgatcccaggagacaaaagccctgggcagagaaccagactacttagcctgggggaagcacaaaaaggcttgtctgagatccataagccttttttttttttctttttcttttttttttttttttttttttgagacagagtctcgctctgtcgcccaggctggagtgcagtggtgcgatctcggctcactgcaagctccgcctcccgggttcacaccattctcctgcctcagcctccctagtagctgggactacaggtgctcaccaccacgtccggctaattttttgtatttttttttagtagagacagggtttcaccgcgttggccaggatgatctcgatctcccgacctcgtgatccacccgcctcagcctcccaaagtgctgggattacaggcgtgagccaccgtgcccagccccaaaagccatttttaaatacattgcaggtttctatttaatgttgttattcattttgatttgcccaagtaatacattaaaatttctcattgtaaaccattcaaattacagataaagtccaggcacggtggctcacacctgtaatcccagcactttagaaggctgaggtgggcaaatcacctgaggtcaggagtttgagaccagtctggccaacatgatgaaatcccatctctactaaaaatacgaaaagtagtcaatcgtggtggcaggcacctataatcccagctactcaggaggctgaggcaggataatcacttgaacccgggaggttgaggttgccatgagccgagatcgtgccactgcactccagcctgggtgacagagtgagactccatctcaaaaaaaaaaaaaaaattacagataaaaccagcattcaccttggccacttccttcagtatcagtttcctcctccccaaaagtgaccactgaaaccagcttggtgtgttgtgatgagtttctctgtggaatatgtttatgtgaaatcccatcttcaaccaggaaagcttgagagggaaagggctcagactgcagtttgcaggatttcaattagatataaggaacagttgattagatgtaagagctgttagcaaaggaaaaccttataaaaactaggagctcttaataactagacaggtctttggtcagacaacacactgactgaggacaggaggatggattcgatgacctctgaaagtccagccaggactctggaggactctgaggaatggtctgttccatagcctgcctctgtaatgcccttctctcttgcctattgtctggttgttgttacagtctgagcttttgtcagagctgctcctatgctgtgagtggtctgattttctcagcatctctggggtttttgcaaagcaaggaaactctgtgcatactctggggctgggagttaccaactcactttcgggaaggggaccaaactctcggtcataccaagtaagttcttctttctggctaattattcttcccgagaagcctgtcttccatcatgcagaagctgtcaaaacacaggtggtgttttctttgcttggtttgtgttgggtggttagtaatatcagttggaaaacaaggttattaatgcacatattccctggggcattgtattcggacatttaatatccatgtagtctctccctgtgaaaatatgtgaacctccacgaaaagaaaggtccaaggaaagtagcagggaaaaggcaggaattggatgaaaatagccaaagagcctgcaggaatataaacaaggcaggatcccaggagacagagcagtagccactttgagtgaatttcccaggaggtgctcctgccaaggcccataccttcaaggaaaattaaggcaaatagaattgggctggggagttgctacttattagtattcctcccacgttctaacctaattataaggaggttgttttggccatgggcagtcatctcaggttttgttttcctgctttcctccctaacctccacctgtcttcctagaggcctgagtcaaggttattgcaatagcactaaagactgtgtaacaccaatgcaggcaaatcaacctttggggatgggactacgctcactgtgaagccaagtaagttgtgttcttctttgcctaggccttcaggggcaatcaatcaaaccattagtttgaaaaagactttaatcctatgcatctggttgggctctttattaatgttctttccccaggccaaagagagttggttctcttccctgctttaaaatgagatatgagtgcatgtatgcacacacgcatgcccacatgcagactcttgctctagctcatggtaagggcttctcaggagcatatacaacattttgaaagaaatagagaaacaaacaataatgagccaatggagctgtcaggaaggttctccaccacccctgaccaggcttcccagcaggatctctggccatataggatgtgcttgcactatatcggatggtctaggatgggaaatatctctctgtaattaattccaaaatttggcaacccttattgccagaaagtacttctcatatctaagtttgatctccctgctgcgatttaaatatctacttgaaaagaaccactagaactctgtacatctggattgagaatcaagtaactgccatagaatatgaggctgagcactaagcccacctctgcagcacctctgacgtgtcatgggtcccctctggacattttgagctcaagtaataatggattaagcaggatagcacaagctttggaaacagaaaaacctgaattcaagtccttgctccactacttacctagctgtgtgaccttgaacaagttacttaatctctctgagcctcagtttccccatccacaaaatgaagataaaaatattcctacctcgttgagtcatcgtaaagatgaaataatacagctaaagtagttagcatagtgctcagaacatagaaaaagctcattaaaccctcgctattaataataatgataaacatcatctctaacccacagcagagcctttgtttggcccctggggctcttctgtcaaggttctgttgtgcatcagcagcagagctggaattggggggagggtggagaatgtcagcctgttctatgaaattcttcacctgggatttgaaagtggaaatacaaagaatcctgactaatttaaatacaaaatcatccaagtgtcagaggcaggggagaggtttctgcagagagctgcatagctgggatcctcaaggctacacacacacgcttggagcagggatgcggttcacaggatggcagggcaaaggttgcagaactgaaaccttgtacttccccatcaccaaaatgaccccagcatgatttcctttaaggtgtcccgagccccttcccaaaagacaggctccccatgtggaggggcaatgacagagggaagatggaaactttatgggaagggcgatctatcccaaggttgtccttctcctcttcagggtagtgaagctcatgagaaatatggctcctgaaaatagccactaaatgaaactctccaacctggaggtagaggatcagtaaagtctgcagaggcaaaatgaggcagtttatttcaaagaaaagaggttgagggcaaggtgggagttaagtcacacatctaaatctgggaaaggaagcattaaacagaagacggaggggctcggctctccacctccaccaggattcagaccacaggacatggctaatactgcaagaagggagttaggttagtggtaaaacctttctaataggtttttgaacagtgaaaatgagctgtcaggagtagttgccagggcactttctctagagagtttttgaaaggagatagacaccctgctatcagaggtgattggagtgcagccctgcctcgaggcaggaggagaaatgagagaacctcttaaagcctctttccagcccccagagcctgtctccatgaaaaaggcccaggctcattaatgcagagctgcatcctccaggacacagggggttgctgggttgttaagtttggaacctttgccggcttagtggttaccaaactccctttgttctcaagacttgacttgataaatgggctggctttatccctttaaagccaaaaacacaggttctgagtgctgtgttgtttgtggtgttgagatgcccaggctggagggaggaagctctagggggtttttgctgagcccagaaacactgtggggataactatggtcagaattttgtctttggtcccggaaccagattgtccgtgctgccctgtaagtacagttaagtggagatagaaaatgagtccagtgcttgatgtggggagaagctgcagggtcttgaggccaggagtccaccgtgacctcaggagtggtgatggagaagaaggttaaaaaaggaatgagaaacagaaccataaggacaatacagaggaagggttcattttcgggaaggaaaatcacaaggccgtgtgattaacgctggaggaaatgcactcctttggagggtcccttctcaggagggctttgtgtcggggaaagctgagctgttaggtttttgatgctgagataatcactatgcagaaggacaaggcttctcctttatctttgggaaggggacaaggctgcttgtcaagccaagtaagtgacatataatttatatgtgctgaatatgattatctccaagaggaaaacttgccctcttttccacgggtgcctccttgggtcaggaggacattaaaggtgttgagcagaccaaggcccagtacctcgtcaccttcttcatccttgaaggagctttaagaggtgtggaggggaagaaacccaccaggaccccaccaataagcccagccttgagacccctccactctgtcagacttgaataagaaccatctgagaacaaggtcttcctcagaaggggactccagcatagtcatccccatttgatagattttgaaactcagggcggggcagagtggctcatgcctgtaatcccagcactttgggaagctgaggcaggtggatcacttgaaggtcaggagttcgagacctgcctggccaacatggtgaaagcccgtctctactaaaaataaaaaaaattagctgggtgtggtggcacgcacctgtaatcccagctactcagaaggctgaggcaggagaatcgcttgaacccgggaggcggaggttgcagtgagccaagatcatgccattgcactccagcctgggcaacaaaagcgaaacttcatctcaaacaaacaaacaagctcaggcaagtagaggccagtgattaacactcttccaataggaacagatcccaagcaacctgcagtagtttttccagtaggctcgtgaactcaaaacaccaagttatttaaatgacagggcaaccgttgtgatcagctgtcatttgagtagtgctgaggactgggtctgaccttgagtaaacgcctaggctggtgggtttctatccctgcagcatctaaagcggacgcccaggcttcactgaccccagcagtctggctttctgcccttgccgcccaggaggtgcagctcttggcacacaccatccttagtgtcttgaaagaagagaaattaaaagagaaagggggaaaagcttatatctcatatcatgcagttgcctcattttgtagcaagattgtttccccatgagcagtttgtcttcattcagcagctgtcttctctggggaagccattttgtagaggtgtttgtcacagtgtgacaactgacagctgggggaaattccagtttggagcagggacccaggttgtggtcaccccaggtaagccccattccctggagcctcacctgcccttagtatttggcatgccctgcatgccaaatatttctagccgagactatgagaaacacatctgaaaggaagccatttccctgaacagcagtacccaaagccattaagcaaaaatgagagatcagactggtgttaaatagaaacgtttttggataaatagtaattctcattattctctatcagtctcctgtgtgaatacccttatttcccttataaggaaaaaagttacaataagcaggatagccatgattcatgctgtggtgtgggagcaatctgctgtggatttgggggtggaggattagaaatgtgttcaggcagactggatgtgtttttgacaggatatgtaacacagtgtgatttataaccagggaggaaagcttatcttcggacagggaacggagttatctgtgaaacccagtaagtataaaattgtatccctggattaagcaatgtctgtggattaagggctgatttagacccaattatacaccatatgaagaatgtttagagagggggatgagcatcaaataggaagccaatcgtcgtcctggctaggatctagcatctcagtgcaaaatgggctatgtaagtgtgcctctgggaattgctcctgaatatatgtgttgggactaaaatgtatgactggctacttgttgtattggctgggatcatatccctggatttgtgcagtaattggtgacaagatttctaattccttaacaaaccttctaaggcactattctatttggctaagattatgtcaatttatagaaggaaagaaccttgtaaataatgatcattaaccaaaagtaatgtgattagtctctctcaaagtctgaaaaaccacttttttttaaaaagtttactcatgactactgagggacacttcctgtttctgagactttcagccaaaaattcgtacagcgtagcctcacggagcagagagaaccttgacaacattcctttttgactttctccatggatgagaaaactgaggctcagggaagagacagatcccggccccacagccagtctatggctgagctagaactagattttaggtctctaatttgccaaacctgtcagttggctcaaacttgaagtttgaagagtccgcaagattcatctgacaaatattttcatgtacttgccctctgccaggctcgttgctgaaaccagggatccaacaggaagcaaactcagtgtgatattgccttcatgaaacttacattctggaggtggattccatgtttcttcccagatatgacaatgcttaccctgatttctcttgggcatggctctcttatactatcatcacttccttaggaaatactaaaactaatttttgctgcagtttaaagtccttgagcagataactaacacacataccactttagtcaggagaagggaaatgcccaaaagtgaagtagaaaactaggaatttgtctgataattgattattataaagttattttatcagtgtgaaatgagtggccaaattaactggacaatgccagctctgtacctacctcactttgattctatagactcagtctcaggaggattcaagaattcagacagttctctgatgacataatccagtgatgcccacaacagaggaggcgtattctctattctggactttgtgagtctccttggatgaaaagattcaagtgctgttttgacacctaaaatcagagagtatttgctctatacatatatcgaaaatacacagttaatgtttagaactttgtagtggaaagtggaaagcaaaggtcccctaaaagaaaatgggattgtaaagacgaaggagggttagtttaggatttgtagaaagtcagtttggctactccagaccaaacctagattaacagtgatgcaggcctaattcataaaggaagcactgccagctctttattcagtgctttgccaacctggcctgtttgatctggtttttgttgttgagcaaatcatagtgtttcttctggttctgcaaggcaactgacctttggatctgggacacaattgactgttttacctggtaggctgcctcaattaaatactatttgcactgatttactaatctacaaatgtattctgtacatgtaacttaatgggcctgaggttgaagatggggagagacagcaacaatgcatactagaaagggtaatgcgagcagagaattatttatcagagaccaagaagagaaagagaagctttttgctaaggcttttagtaataggagttaatgaaaatgaatagaaaaaaatttcattttaacttagaagaattgctgaataatgggaacagattccataaggggaacctctgcttctgaaaatatttgcactaggaccagcctacgtgctacaaaaactgtctcacaccaagtctagttggtcacttacatttttagcctattctagtagctatttctaaataagtctttaaacatagaggtgcctatatttaagatatttaaatgaggctctatttctatagctctctggtgcccttccagcaaagcattgctgtaacacattgcttatcatttctacaagtgagaacaagtaagcccctggccctccaaaattgcatgagtattataattacttggcttagattgaagtcacttctgtgttacttctcataactgtgttcatttgttgagatctgtttaactccaaactgtgtgggcgtctaactgttggcactaaggtttcttttctcttgaaattgccagcaaaatattttacccataaataatgtttcatctagacttgcaaatgacaactaacactgcaggctctttttttttcttttgctttgtttctttttttctgaagggaatatgcaagcaggaagcaaaaaaaaaaaaaaagccaaaatgtacagtttgactgtggggtctgggaggagagtgtcaatgtggatgctaaaatatacatggttgtataatgtaggtactgtcacagagaggctatagtgatcttattagatcatacatacagagcaccactggtcagctggcgttgctcggggtgtccttaagaaaagctcaggtctagttgtcaagtgcaacccagattcagatacagagtctcagagagaagcttccagatcaccctggagctaaatgcagaatatgaattttccccttagttaagtctacctgaggggaattttcatttataattaggaaaagagaaaggtaaagaacatttacttgcagtgtcctgtttcaaatattgtgtgcattgagcacagaggacacaagaatgaacccaagcagaaaactaaagaaaagaaatcaataaaaccactgaagaaaaccagttgcccttatcttgcctgtctctgataatgaatgtgccttccctgctcattcctcactttggttctcaaattttccagggaattagcaaagaactggtagggttgggttagtcttggtctaatttggttagtcatctctggataacaagtctcctttttaggaagtgccaggggattttttgtaatgccaataaacatggtgtacaacttcaacaaattttactttggatctgggaccaaactcaatgtaaaaccaagtaagttatagttgcctagaagaaaaagttaccaacacattatgctaaattcttcttttcagtctgtatttcagttcttttattttgcattttgggtccccacccatgatattttattagtccttattcatatgtcacttgaacagatatgtagtaaacaaatctcatgatcgagtagacatgctgaaactgccaatgttctcaaggtgctattctttataaggaaaatgcccaaattttaactgttgctactgaacaaaagagcatttggatataatttaaagcacccctgaatgtccaggatttcagagaggagacatgacaaattaaaattatatgtattatttaaagatgaaaagaattagatcctcttgaaaatactctaataactaacatttcttcaacattcgcaatatgcaaagcacctttcataccttgactcatctgaccctcctaacaaccctctgggatagatattacctatctccgcttccacagatgaggaaacagtgtgaaaggtaaaactaaagcaaagaggttgaaatagttacccaagggctcaccgcagatgaggggcagagctagattaagagcctggcctgcctgtcccctagcccactctcttaaccatggtcttggtgaggtttgtgtagggcgacctcgcactgtggttctaacgactacaagctcagctttggagccggaaccacagtaactgtaagagcaagtaagtaagaaagaaaagtccagaataattttaagcaaaatggtgggtaggtttttcagcaatttcacctaggaagtgcaatgtcaagaactaaattctaagagctttcccagtttgtgttagaaccataatttttctacctcacacgtctccctcgccttctctgtcacctcagaacagctcctcctaaggcatgacttcacaatggtacatttgttggtggcgcagtctttgtggtcagataaaaactgagctaattatctgaaattatctcaggtctctaagtgagagagttaactcctttcaaatatttgaagaactacgatgtagaccaggtaaggggtgagtgtggaggccaaatcaaaacgagcaggtgcaagatgtgccccaacctcccctcaaacattgttgaacaagtggaactgccctgcagtggaaaggctgctttgtgaagtatggaacttttcttccttagatatcttcatgccagacccctaaggttaaccatgagatgttgcagaaggcacttctatgccattttagctattagattgaatcacctctgggctccctttcaaatctaaatgctaagatcccatgactcaagcctggaggattaataggtgagctcagacttgtttcttctatttttactattttgatagccaaagaaataattcatcaaattattcataagctaaagcctacttgggatttttacacctagaagatggtggggtatgatttcccagtgcagtaaatgagaaaacaataggagacatcaaggaggaaaaaaagaaggaagagataaagggaatgtcttaagggaggctcagaggttgaatgaaggaaatgaggtgattttgcagaggacagatgtggctatcaaagattttacaatttcacctttggaaagggatccaaacataatgtcactccaagtaagtgagcagccttttgtactcgaaaatagggccaggggagcaaagtttcttccaatttaaacacactcaaaaggatgtgtaattgctttctgatgggagggaactctgaaggtagaaagactattgttaccacagatcacttgtccctggagatatagcatctgaggactgactgtctagcttagactgctgtctgcacaagaagaagacttacagatgcttaaggaggatggaggcaaattttcaaccctgtactccaaagctgaggggagaggggatgggaaacattagggctgggttcatgtaaaggggaccagcattgtgccgacagaggctcaaccctggggaggctatactttggaagaggaactcagttgactgtctggcctggtgagtgagtcgctttctattccaggaaaatattactgtggagaaattaaaaggggagatgaattaactcctttagtcttgaaactaaagagatatgtgtacttcccctcctggaggaccccagtccctaggtagattaggacgaggaagcagagggagacaaaggcgatggaaagtcccttttaggaacccaggaatcagagagaacttgatggtccccaccaaaggcaaagaagggaggtcccactaaaacatgtgagcatcctaaaacacctgctctggtccacccacaatatttggtgaaggacatggccctccacccagaatgggcaagcaaactagaccagctttctaaggtgtgtttttcttgggtcctgtgactcttggccgtctccctgtcagaggctccatctgtcgctgcactctttcttattgagaatggcctctccgtggttctctgtaaactttccccaagaagcctgtttccatgcttcctcagcacttagcctcaccgatggatgggctctagagtagctggagggagtctgggtctgaaactttcactgagaaagtaaagttgatccgcagtatccagtggatatggcagctgggaggacctaggactgaagtactcgtcctctctttggggcctttcctgggcactcgattgaatacagaaaccctgttagcaagtgcatgcatgtatatgagtgtgttcattcagcatttccattctgaatgtatgaatagccttactctgaagactccctggagcttacagggctttctgttttcagagaaaattgcctttgtgagacaaaaatggccaagtgggcccctgaatgaggttatggttgagagctattaatattatccttattcacagagcaagatccgaattcccaaagcagagtagacaataactatgtgaagggcttagacccaaatatgtgcccacttgcaagcattccagctctatgaagaggatacagtgctaggagataggattaccctgcacattgcaaaccctccacttttccaagaccatagaaaatgtcctttgttgagcaccaactgagtgttattttcttggtccctgtggtttttgctgggccttaaatcattgtgtgatcaaagctgcaggcaacaagctaacttttggaggaggaaccagggtgctagttaaaccaagtgagtactggggcttgacccacaattgagccttgtcatcaatttgcaattcaatgtgccgtattggcccaaattaatgtctcaaacttgtctttaaaatgtttcatgttgctcttatgcataaacatgcacttatgtacaaattcagcatggataaaggatattgtcatcttgacattttctagaatctattttcttaagagaaggcacatagtaaaaggtacttttcttatttcttcacatttcttaactgattttcccaagaggcagaggaacttggacgtggcgtttctgtctattcagagtagttgatttgaatatggttacaatagcagagcaaggacttacaatttctaaggttcaaaatattgctgtctgtaccagcctgcagcctctataaccattattctgatttatttcctctggccctcatttttcccaattaatgtaactgaaatattggtaaccattatcttccggttcacagaaagtgtgtgaggattaaaaagtcgctgctctgaaaaggaattgagctggagggttttcttttgggggattattgttttgttgatggtattgtctctttcattgagggagagaataagaaaggaggcatacttgaaaggcaaggtaatatgatcaatacatgaacgtgtgcaaaataaatcattaaggcattcaactagaagccaaaaaacagtatggaccccggctcagccactcactcactaggcagccatgagaagatcaccaagctctcccagcctcagttaacctaaaatgtggagattattattccagccttgactacttcaaaggatgctatgaaattcagatgagataatatatgtgaaatctccttgaaaaagatgggtggtcaaatgattcatgatttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacgaggtttcaccgttttagccgggatggtctcgatctcctgacctcgtgatccgcccgcctcggcctcccaaagtgctgggattacaggcgtgagccaccgcgcccggcctcatgatttttaatagttagattttatgcaaaatttcatttgagggtaaacttaaaggtgaacaagtttaatggactttggccatggcagagaaatggttaggtttggatataaggtggacctctctaattataagaaaaaaaaggaacatgagaattggtgaacaagaccttccctggagatcttcagaaacctgaggtcactcaggagagaaatgtgtgaagttgagagcttacagtaaatggtctctgaagtttcccaccattccaaagagtgcgtgagcttaaaatttttcgtgagtttagctaaatatgtgcttagtgttagattaggtttcaaccaagcaaaagaaccctgggagaagtactctgcttggaaatgaagcatcctttggtttttgtggtacaatagatcactgtgggttttcagatggccagaagctgctctttgcaagggggaccatgttaaaggtggatcttagtaagtattattactaatgaattcttaattgattagtttttgagacaagtaataagcttttttggaaatctaagtggactgccaaatgttctcgatttatccatattgcatggggagcagagcattcttcatgccttctccatcctcacttctgccaggtagcagtttgcattgttaacagggaagcagaatggaagcttaacagagaagcagtatggaagacgtctccttagcccagtggtcagttgcatcagagaagtctgctctgaaatgcgaacactttctcttgcagctggcagccccctgcaacctcagtgccctccatggccagggccaaagcttccaggtgcccagataacatcccaaagtcactctgagagaagagagaaaatcggtcttactttaccttttctaaccaggaatttacatggttagttttacatctaacacttcagcagggagaagacatgatctaagtgtccatgtggacactctgtgtgactcggatccaggatctgctctttcagcccctccatttatcgcaaaagggatgatgattaattcctccatgcctagacttcactttagacatcacctcagagaggcctgtcttacccagccaatctaacaagccatcaaacacagccactgcctggctgctctctaccctgttatttagcctgattttaattcacacactttcatcacttaacattatactatctgtgtatttattgtttgccttcttctagaccgtagacaccaggaggacggggacagtgtctaagtggctctcaccgtatccctagtgccggcacaatgtctttacacatcggaggtgttcagtgaacagttactgagtgaataaaggacttagcaccaactgccgctctttttcatgaaattacagagctttgctatttcatacccaaatactaaaacctactgagatttttgcaaatttccatcatttatagttatatccaaggtggatttgagtgagcaggtacatgaggtatttgcagggcctcatttcactgtgccaaccaggcaggaactgctctgatctttgggaagggaaccaccttatcagtgagttccagtaagtacctgataattattgatcatagtgcttgtacttatcctgtagtcatatattgcacaggtgaccaaatgcctcctatttctttgagttaaggaatattgacatttgatgaggaaagccatttaaacacatgggaaaattggatgttgtctctcacccctaatactccaaccatagcccctgtcctattccatgctcttaaaaaaattttaattgatagaagaaagaaagattatctacaaggatatgagcaatttgctaaacagtggtaaaacgagattatgtacaggtgttgattcctaggtaaaaatgggggtcagagctgctatcctttggctagtaaaacaagattacttggtgaaattatgtaaatctcctcgaaagaaataagtttcagagttgtctagagaatatcacttggactgttctcaggctttccactacatctattgtaccactatggtgccctgaaaagaggctttctcaggcttaattccatggcttagtctttattccagtatcaaaaagggggaatcccagccagagctcccatgagggaggatagctgcatgctaaccacattaatctattatcaaggtaactcggtcatttttgtcaggcagcacagtgctgtgatttatagcacattcatctttgggagtgggacaagattatcagtaaaacctggtaagtaggcaatatgtcactaaagtaggaggcttaatgtggctactgagacccactaaacttactgcagtatttggaaggcccaagtgtcaagaaattaatggtttatgcagacttaagtggattccaatgaaggaagaaatgttaaagtaatggcacagaggatagaagagctagctgtgaaaaaaaatagccatgtggatgaaccaaacgcaacagactgaaagagcctagagagttgatcctaaagaaaaaggcagaaagtctggctgagcacttccagttctgctgacctggcttgattagtgaatctgggccacagtatctttatctataaaatgaaaacatttaatatcacctcagattttttgttttaattttgtgggtacataataggtgtatatatttattttaaagataagctaatatatgtgaaagtattttgtaaattcttaaatgctatccacatgtaaaatattatttgtttatagaacaaaaaaaaactatgtcagatttagaattcttttaacatgagaatttgtaggttcttagtgaaatagccatttacatgtgatctgtagccctaggcattggtaaaaagcactttctcttctactgaaatatagtggctcaaatgctacccaaatgaaaagggcaggggaagggaagtcattttgtaaaggcaggcattacagtgtgaattctgggggttaccagaaagttacctttggaactggaacaaagctccaagtcatcccaagtgagtccaatttcctatgctttcctcttccttgtgttgtcttctctcagaccgtaacatttggagcacataaagagatattatgggcctgctcttttctggctgtttcaggagactgaaaaggattgtataagaacatcctttagcatgttcttagtattgttttgtccagtgtgtgtttcttcttaatatcaaaaaaaactaagacattgcctgtgaagccaatggaaaacagtagatttgcaaagaaaagaactaaagagaagacaagtggtactttttaccaagcttaaagcagagtgggtgtcctttaatcagagggatgcttggttctgggggctggataggactcaggtaagtaacaaggctaccactgagtcactgagcttctaaaatgagttgactcgggggagcaggaagctgccactcatgatgatctgaatgctattccgtgaagtttcagattgattgaagttaaaattaggggtgacactatgtcaggaatctaaaaattgataactgtaatggaaatgaaagaagggctagctacatctgttggataaatggagttgaaaatcatgaatttgatggcgacagacccagagagttgggcaggtagaaacttcatttcaagtgatatgcagtaaataccccaaatttgagtcaaatggcctgtgtaaaaaggaagtgaaaatgtaacccgtatctccttgtaggtgaaaaggccatatctctaggtcttaggtatgaaaaggatgtgtgggcttctgggtgtttttgactgactaagaaacactgtgggatggatagcagctataaattgatcttcgggagtgggaccagactgctggtcaggcctggtaagtaaggtgtcagagaggcaacagaaagattgagggtaaaatgtcttcatgtctcaggaaatgattgtataatgcaaaatgagctggagttttttaggagcactgttactagagttctgatgtctggttctagcaaaagaaccctaatatagctgtaatccctctctagaaggaacaaggaagaggattcttctctgaaagctcctcctaagatttatccatcctctgccaaagtgtcttgtggatccaggatacttacatctttgttagcagtgctggcccaacctgctcagcctcagatcacctatccctcatttgtaaaatgaggataatatttaagctcatggcacagttgaagcccaaatgaggtagtggaatatatgcagattattaatccatttggctcataaatgaaggttttctttccttttccctaagtagatcatgggttgaaatacctaacactgcaaatcatttttgtatggggatttgctatagtgtgaattcaggatacagcaccctcacctttgggaaggggactatgcttctagtctctccaggtacatgttgaccccatcccacccatgttttccccctatctggtttaaggcttccatatgtattgcgtgttatcctcatggatttcatcatccttgttttattatcaatgttctgtgaatttaagattgagcctccatggactcttcatttaaaaatgaaaatagctaatagaagagttggaaataacagtagaactaattcactaggtcaggatggagaagggagtaataccctagacaattaggacaaacgtggtttttccagaaatagactcacttcctgtttaaagcctagactgtggtctctccccgggcacccttcacattcctctaaccctccatatcccaaatttagctgtggaatcttagacaatctgtgacctatgcagctacagaaatcttttcttactgagaatatctgcctatttgaaccaaaagatccttgagaatagacagtctctaatattccatgaagtgtctgatatggtccttttacaaaagtaaatacttgataaattcttgcttaattgaagttaaacacccaaagaaatcaggtttccaggccaaagggaagaagaaaattaagcaaatgacacagtacatttgagcgtgtagtggggaggaagaaatgctagattgggattcaaatagagccatgttttggtctctgctgccaactagcaatgtaacttagaccagatctcttgcctctaagcctcagtttctttatctgtaaatggggaagtgggtccaatggcctctctggcctcttagtacaaaaagtctatgaatgtatcccatttggggcacttttttctcctaggagtaactcaatagctattttaaagcttgagtgttttctaactcattagagcacatcaagaagaggggtgaagtgacaaaagggagtttattgtgaggcatcaaacactgtgatactcacgggaggaggaaacaaactcacctttgggacaggcactcagctaaaagtggaactcagtaagtatgagattctatggtaattacaaaatgtattctggtgacaataagtggaagaaaaggtgatgtaatttttgtcattgtatcttatttttaatctattactgaagcattaagaattgtgacatccagataaattagtgaaagtattcaaaggctatataagcatgctttcgttagggtggaatttagctaaccactaagactttttccaagatatgagattttcagctctcttcaacgtgagagtttttaatactagtattaagctaaacgatgctcaatggaagaaaagagctagaagagcagaaaattgcaccgtcatgatcaaatagatcctttctacttccactgccatggactcagtggtgcatttagaagagggtattcaaggtcattttagccatgccccaaaaaaaccactcccaattcattccagagattgtgcccccttatgctaaacatcatccaagaagagtcagtgaagtacagagaaaggaacccagggcttcttgtttcggtccagagttctaggtttgatttggtcccaactggatgtgtgatattggaacgagtcattgcccctctctgcacctcagactcctccagtggatgagggggtcaaagccctcaaaatctgttgttctgggatttcgctattataccacccgagagtttataggactcgagagtatggaatcttgtgagtatttcataaacaaattctatgaccctcaggaaatagccctgttaatcaacaacctaacttaacatagaaataataaccaccatctcagtccctaccatgtttagatacgatgctagatgcatgacatgtagaattgttcatctgaaataactctgtgaggtaaggggaagtatcttattttacaaaagaagaaactgaggctcagagaaggaagtgcccaagatcccaaagctagtaagtaaagggcctaaatttaaacttgggtctgcctgcctgactaaaaagccctgctctttcttttattttattttattttatttatttatttatttatttctgagacagagtcttgctctgtcacccaggctggagtgcagtgcagtctcagctcactgcagcctctgcctcccaggttcaagcgattcgattctcctgcctcagcctcccaagtagctggggttacaggcatgcgccaccacacctgaaagccctgctctttctactgcatgatgtcgtagagcttgtgctctagtttacttagaaatgagaggtgatgccaatcacagtgactggtgaaatgcttggaatttatcttttctactttagatattgctgtgagttagagagggtgcttcgggaaatcttgacatggatgccccaagtgtctaaagagttctcctcccctttcaatgacaaaacaaagtacagagttgctgggagcatttaccccaatagggagaaaagagaggggagctggctgcagccactcccttgttctgactgtccctttccttcgctgtttcttgtattttccccaggcagaccagccaccaatataactgatctacaagagcctgactcctttgtgagttatagagaaatgcagggtgaaggcactttgcacatagaactttagctctgagagacagcctcaaaatatctagttcacccctctttattttcccaataaggaaattaagacccagagaggttggctgaattgtctaaggtcagtgcgaactagggctgggactagaacctggagatcctggtcctggggccatattctgtgactgctgtttggtgaactaaacttctgataggtaggaagtgtgagttatgctcataaacaggaaaaacaaataggttttacaaggggagtataaaaatgtcctccttattactagcaccttagtataggctccctagacctgctccccagctgtggtgtaaaaatggaaggagaaggaaatggcccattttgtcgcagtgcaaatcactgtgggaaatactggaggcttcaaaactatctttggagcaggaacaagactatttgttaaagcaagtaagttccatgaaataacctgatttatattacagttgaagaacatctgttttcattgatttttttctttttagggggaaggggacatagttttgtctgccagttaaattagaagatacattggcaataataatgttgcactgtacagtatccatgggcatcactcttgcaagaaacatgtataataacaaacagttaagtgtggatggataaaacttccctaggtcctatctagaactgaaactctgtaattatattaataacttttttaacttgaatattagtgacatttttatataacccaaggtatacaaagcagaatcttcagttgggttctatctgatttgttgtcatcttccaatggtcttaggaaaattaaggttaaatagtaagattagatgcctcctaccactttggtacatgcatgcagacatagaaacacccttagtaactaacttgcatgtgacttggcaatcctaggctatggcccagtgacagggtcccattttgtacagagttatgtcagagtgtgaacacaggctttcagaaacttgtatttggaactggcacctgacttctggtcagtccaagtaagtcaaatctgcagaaatgtgtagccctatcctcaatattgggcatatatggatataattattctggtctataatagattattattactactattttgttcttattaatcataacaatgctgctaatttcaaatatacattttctgccatattattatttttacctttaaggagaattattgtcaagatatcaggagggaaatatttgaatttcctttgagtcaagtttcttatttgttcgtcagttcccacctctctgctgagggtcatatgaacctcacgatgttttggtttttataccgccttcttattatctctcttagaaatgcttccttggtttttccttgcctaagcacttagattttgcagctcacatttacccagagtatacttagcttttaacctctcccaaaactggcctccctgtcccaataattatgcacagtaaaagtcagttcaattcagtaaatgattattgagtatcatcaacaaaccagggaatcatcattggttttaaaagaaagaaacaaagaaaagaatttttaaaaccctaagctatcttaggcttctgatctcaagaacttccagtcttatcagagaaactaagcactcataataaaaagtctaacaacaatttatatgtgtatgtgccaagataggggggtgggtttcctgagggctggagacaggacaggtatgaccatgcacagccgcattctttggcagagaacacacatgattcccccaaatatgtttctggaaacggaattgagtctgttctgtgctgagatctttgactttcttgaggacaaaagcccccttggcagttagcatccttgagcgggggtgaggacagaaacaggaatgagtcaggcgtgagtcacccaagactctcactcagccccaagaggatggagtgactctgagtcatgccgaggcatgtctttagcatgtgctccagcacagtgtgcatttatggcaaggtgaaaaatacatttttgcacatgtcactaggaaaatggtaccttcttctcaggcatggcagatgaagtaggaaaatgcccgcctgctctctggtatctttagaaatactcacacccatccagcctatgtaggatacaatgtttttcatgaagttttatgaagattctgtttttcccaaaggagaaatagccaaagctgtgtttattgatagctgtgatgaggaaaatgaaggccaacaggtagcagtggggtctggtgctgtttataccctttagggaggttccttcaagtcttcataccacccattacaaggaaaactttagcatccgcctttcagggtttccagatcttagagctactgtgaaggggatgtgtcttcagagaaggggtgggcaaaaccaggaggtttttgtaatacacttacacagtgtgactatgggaacaacagactcgcttttgggaaggggaaccaagtggtggtcataccaagtaagtgagctgggatcctcctgcacaaatggccacagccacccccatccctaccctgtgctggagagcctcttatcatatttccatgggagcgggggaaggacatgccattcatcagtgctatatcgaagaaccttaggcggccactgtcccaaatctttgcctgtccctggtttctttcactctccccttctctgcatctccactgaccacactcccattctcatgtaagctgcccctgatcttccctgaggctggatttcagattgaacaaaggaccacaaaagtgagagctggaggggaccgtggggacatcttgctcatgttgcagagggacctgatgccagggtctagcatctgtccaagaccgtgctgatggtcagtgcacagcagtggaggggccccagccctttactcccaccctgagtttggtggagccacacagctctttgctaagtgaccctcaaacccagtgtgagataagctgagtgttgacagtgcccacctgctagggaaccaagtactgagttcctgccccagctcaggactgtggcgcaggccatgacctccctgagcctcagttttcatatctctgaagtagacagcatggtctctgtttcctcccatctttcaaaaattctatggaaattattgtgacttttttctctgtaattgtagggtttcacagaggcagggccttgtctgagtcaaggtcattagaaataaaggaatccaagggctttggatgccttggcctaattctaggtggtaaagagggaaggatgaaagcacaaatcacaggaagtgcctaaatcctgcttggatttagtgttgcctcaaacagggatatgcagaaatccaaccccagggtctcccataggaagaagactaggagtgggaagtgccaaagagctctggaaaggaaaagagaacaaggagcactctgagaaaaggaggtcagaacagcttcaggaaaaacgtcacataaaatttcctttgctctctgtcctcgcagcactttcagaagctccttgcatctgactaaagagtagcagagccagaccctcagaatgtctgccccaagcaagcagagtgtggtgtttgtattggggtgctgggagcagacatggggagttgctgccctgcttctctgctgatgggaaggtggtattttcccctgggtacacgggggccaaagagctctccagtccccagcccctggctcccgcccctgggctccagcactcgggggctctaaggacagcagtaggagactttctacaactcagagagtattcaggagggtttcccaggatgttgcccaataccatggggcaattggtagagggaggtcacatgaaacaggttttatcaaaggctgtcctcactgtgtgcatcaggaggaagctacatacctacatttggaagaggaaccagccttattgttcatccgtgtaagtattatagaaatgatcaagggaaattttgcagacagattatattatggaaggatactgtagtagtgagagtttgtgttgtgatctattccatcattaaaggagtcctttgttgcctgggagtaactatcagtgtcaggtctgatgagatgattgaggctgtgccggacaagggttttgcacaatgatttcagaggacaaatccccaagttgtgaaaaaagacttcactcttggttaggtttctaaaacagaactttcttcttggcaaccaaggggtctactctgccccctcactcctatgtctcttccacctgagactctgtcaccacctcccctagaatccgtgagataccttcccctgaattagagcataccagccagggtgctgaggcactctgtggtactggaatggatggtacagggatgcgtttctgggcttctggctgcaagaagcctcatcctttcccccagtgtaaagcattgctgggaatcatcccattatgagctactatttactgaatgcctgacacgtaccagtggccattctcttgtcttttatgtaatcctcattcagtgattacacacatcctaataataggtagccgatattttgcccattttacaggtgaggaaacagaggcttgggataagtaacttatccaagattatatagccacgaatgacagagctagagtttaactcaaatctgtttgactctagggccttgttattaaccgtgccaccaccatgcctcctgcattctgtgaaggaagacttcacacctcaaaggccatctgtttggcctttggtttgcccatcctgagccttcttaccatagcgaccatggcatggtgactcagcacttctgaagagatcagcagagtcattgggttgggtggcagaatacaggtatggcagggagggaaggagaaacttagggggactgtttattgcgcatacagttagagagaaagaaaaatgtatcaacaaaccatagaataggctgcttaaaagtttttctcccaagaaactgtgagtgtatgagggtcatgggcagctgcccccagctggcagagggcaggattttgtactgtgatgtaccagggtgtggacacgggcaggagagcacttacttttgggagtggaacaagactccaagtgcaaccaagtaagtacccaaacttaggctctggccaaagacacagaaagcccctactctgctttcttagatgatgaatctgtacttcctgaactaatttttcatgtttctttatgaggcttgaatatcttgaaattttaattcctagccactagcttaatagtctgttttctaacggtagtatttgccaatgggaattggccatttcatcattgcagagacagattcctttgagacaaaagatctttatcagaaaagaaactgtgactgattatgccaaaagatttatttttgttccatttagttttcatgaaaggtgatgaattatgcttcccaaagactctgggcattggacacactttctcaaaactgcacatccaattgagagatataggaagaacttagagcctaaataatgccataaaaataataaaaagtttgtaaaaaggaaccatatagaaattaaagaagaaatgaaatagtcttaatgaaagaagataacagaactgcattagaaacgaatggaaatatttagagggtttatgtattcaacaaatatttattggacaattattttattccaagcactatgttaagtgtgaggaagggaatgggagggaagggaagggaaggaaaggaaagaaaggagaggaagtagaggaaggaccgggagggagggaagaaggaagaaaaggaggaaaggagggaaggagggaggttctctttcatccagggaaggagggagagtctctgccatccgggagctcagagtgcaaacagacaactatagcctattgtcaccacgtcatagtggaggtacatgcaagttgcaatggaagcacaacagaagacatgactagcctccaattctcattgcctggtacatacacacatcctccactataccttaagctccatgagggcaggaccctttttcatcctcacagctctacagctcagcacaatgcctggcacataggtgtcaccaaacaaatgattgtggggaaaaaaatgccttctggctagatgagttatgatttatacattaacaaatattctctaacagagagagttgttagacctcaaaaccaggagattgcagaatccatccagatgtctgtggtgggagaaggcccatctctcagggaagagcacctctgtatttatctgttcatatgtgtgcttcatcaaagcctcttctcagccatggttcaggctgaatttataaagcttgaaacctatcgtatttctcaagaatcagagatcagaggtggaaggtttacaatatctcgataagtaagcagtacaaatgagttctagcagtaaaaaagaaagaggtctaatgataaatatatgaagcctgtctccacttgagagacctcctagaaaagatttgttctaaggaaacttttctccattaggagcagaatcatcttggaaatatacagctccaagttgtgttagaaaggtgtgtacaaagaagaccaaaaattcacatttggaataaggcattaaagttgccattgtttctagtagggaaaccctgcaaagtgttggggcatcgtagatcctgcatgttgacgcctgcaactaatctgccccggagctgttccgacagtggctggagcatttgctgcacagttgcataggtgttcaacaattgccaaaataaaatgaagctatttcgtgatgattagaaagaaataatcagcatcaatgaggcctctgatgcatcttcaggagtgagtaggtggaatgaagacctggtaggtgagacttttctctcttgtcagagaaagtttgacttgggggagcctggaaaacagggacaggagatggagtgccccagccaggcatgccctgcccaggtcagagttcttgtaaagcaccatctgattgtgtgttttctggtggctacaataagctgatttttggagcagggaccaggctggctgtacacccatgtgagtatgaccctgcaagtgaccagtgcaaaaagaactgaccacttgtctatgagaaaacaggtgatgatctatagcaaacttggggatatattgagaagcactcattttccattcctacaagctctcttggtgacttaaaatgttcccatttctcatatgaaacacagaagtgccaagagccaattgcgtaaatgaaaatctgagcagaataatttatagaaacataaaaagagttccaaataatgagtgctttcaagtgaagctgataatatcggcaccagataatctgaacattcaggaaattagctaagtgcccttgggggaaagagatgagttaatggcaaacacaaattctcttttattgcagcatgtagctaaattccctggattggctaataaacatggtatggggatccctactcatagaatcttcctctctggagttaggagagttttcagcttcctcctaagggtaaaagtggcccagacccctaactgaacggcaagtataccacatgcaattacaaggtatagaggcagcaatgtagagggaggcccacagacctggggaaaatctgggctctactctcactggctgttttcaataaagcctccactttctcagcagcaaaatgactataactacatcataataatatgagataatggccagaatgtaaaaagtgatcaataagtagtagcttttctaaaatattattataattattattattgaggctttgcttatactaaggtttacactatcataaagggaaaggagaatcgcttccttgggaaataaaagatgtaagcaacaaagacccaaggagccttttagaatgttgctctgggaccccagtggcttccagcagattagcatcaagaaggttatctcaaagaccttacccacagtgggggtacagcagtgcttccaagataatctttggatcagggaccagactcagcatccggccaagtaagtagaatgaagcaggagagcaagggaggacggacaactatttcttctttgtccaaaatgccaacttgaacccaggtattttcctctgtgggctccaaaatggtttcttccacccatccccagaaaatcctcccatccagctctcggtgctctgcagacatcatccttaggctgggaccttaggaaccatgaggcaggcaatgagcgagtactcctgaaccttccacaaacatatccaagatactgctgcctggaattgaggtttttgttctagggaattattggtttattgaaatcatatgaagtcacaacctcagcccagggaatcacagcagaatggaacaggaggagaacttttgtatcagaagcgaaatttcagtgcaaaagagcagaaggtttaggcctggcgtggtggctcacgcctgtaatcctagcactttgggaggccgaggcagggagatcacaaggtcaggagatcaagaccatcctggctaacacagtgaaaccctatctctactaaaaatacaaaaattagccgggcgtgatggcacgcgcctgtagtctcagctactcgggagactgaggcaggagaattgttgaacccgggaggcagagattgcagtgagctgagatcgcatcattgcactccagcctgggcaacagagcaagactccttctcaaaaaaacaaaaaaaaaaaaaaaaaagaaggtctaacccttaggagtgtgattatcctgttctcctgccttgtgggggagatcagtgtttctcttatttaagtaataggtaggtcctgtgagtttgtgcaatggtgtcacctacggtatgaatactggaggaacaattgataaactcacatttgggaaagggacccatgtattcattatatctggtgagtcatcccaggtggcaccacgtgcaaccccatgggccagtgtcactaatcctttctctggagatatcacttattactatggtgaggcttgctgtagatgttgtaactaattttcttacagaggtctgggaagggaaaagcattactatctatcttgaatattcatgtttctctaggtcaaacacattaaaatttgactttaatcattcaatgggtattgtaaaatgccttctatgtgactatcactctataaaatgttagactgagtatgaagtgtgagatagattcctgtcctgtcctcaagtggtataaaaactagacaaaggtactgaactattgtaaattaagcagccagaaaactattttagtattgaccagttgatgatgtcaatggacacaatagagattcagaggggatagggtgctggctgagaagttggcctagactgagaagtttcctgtggtacaaaggattcattgagccctgaaggatggataagatctgtatgggcagagaaaggagagaagggaagttctgggcgtagggaacgacaagaaagaaggcatgatcttgggaataatcaaggcacatgcaaagtagcctaagtatacatctgataataaaattggttgaaaagtagtcagagaagatgtctttttaggcatggaaaaaggaaatactagagcattcaacagaatacagaaattagggccagggccagccattgggaaactgagaatccgatttagagatgcagactagaagtgaaggtgagagcagccagctatggtgccgcagacctcccctctccttcctcagtgggctctgagaggggtcatcccacaccttagaggaggagaaacctaagggattctgtaatagagacacggggcatggtatgaaagtattacctcccagttgcaatttggcaaaggaaccagagtttccacttctccccgtacgtctgcccatgcccacagtttcctgatgctcactaaagcctcggtgggacccagagtgactgtcactaattctgatttctgggtccctagtgcccaaacacgggggacagatttaatggtaaggaagctttcaatcactgctgtgtccctagggatctaaagcactagagcacatgtgcttctgcagttcattttgaatttaaaggacagcttaggatctagaatagctgaatttccacctcaaaacattggttccgtcttgccaagcctaccttctgatatcatcagtgatgggatgtgtttttcttactagggtagaataggatgtctctccccaaaggactctggcagacagacccctaaacacctccaaattaaaagcggcaaagagataaggttgaactagacgtacatggggataaaaagtataaaaggtacatgggaatgaaaggataaaaaggctaaaaaaattaagtacctctaactcagcccctgttgccatttctcagagtcttgtgttctgtggcattgcgctttctagaccaacagtgtccaatagaactttctgtggcaatggaaatgtcctgtcaatctgcactgtcccatacaatagccaccagctacatgtggctattgagctcttgaaatgaagtttccatttttaattgaaaacattttatttcacattgactaatttttatttcaacagccacatgtagctagagactattataccagacagagcagcctagatcttctccagtctgacacccaccagccccaggacttgagtgagtgtttaaccaggactcaaagttgggtttctgccccacaaggccaccccctttcctctttaaagccaacctgcatctggtggcccctgatcccctgccttgaggatcggcacttccagactcctctccccctctgcagtgctgtccagtacccccactgatgactaacaatcagggggatgtgttggtagagctaatggctttctgtctgtcccttcccagcaaaggaactatgccttagggccttcacccagagtgatgtcaggctgcccaagcatgaggagggaagtaggcagaatcctctggagccaaagctctggatgtctctcccctctgaccatggagcccacccctgctccactgctccagggacagccctatgctgcaggcagctctgcccccactcagcatcccaggggctgatttctttggttttggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagtgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagctaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaaggacgccagaaagctgttgatcggcttcaagcaggggagggacacctaatttgcttttcttttttttttttttttttttttttttttttgagatggagttttgctcttgttgcccaggctggagtgcaatggtgcatcttggctcactgcaacctccgcctcccaggttcaagtgattctcctgcctcagcctcccgagtagctgagattacaggcacccgccaccatgcctggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccatctctgactttccattctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggtagcggaactcactaaggggcccatctggacccgaggtattgtgatgataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgggtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgcacttctcccctatgaggtaggaagaacagttgtttagaaacgaagaaactgaggccccacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcgtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattaaccaggtgtggtgctgcacacctgtagtcccagctacttaagaggctgagatgggaggatcgcttgagccctggaatgttgaggctacaatgagctgtgattgcgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttc

SEQ ID NO: 147 - DNA, 575784 bp, Homo sapiens
atgggctgaagtctccactgtggtgtggtccattgtctcaggtgagtcctgggcacaggtgggacatttctgtccttaaattttttgcttttttcatggaactgcttcagaagattctgtcctaggcttagtctgaatttggcttcttattttcataggctccatggatactggaattacccagacaccaaaatacctggtcacagcaatggggagtaaaaggacaatgaaacgtgagcatctgggacatgattctatgtattggtacagacagaaagctaagaaatccctggagttcatgttttactacaactgtaaggaattcattgaaaacaagactgtgccaaatcacttcacacctgaatgccctgacagctctcgcttataccttcatgtggtcgcactgcagcaagaagactcagctgcgtatctctgcaccagcagccaagacacagccctgcagagtcaccgcctccctgtgcacaaacctcctggatctaatcagaaaaccgtgggggcaacgcatccagctgagcctcagcactcggttcagcattctgtaagacctcagcagacatctcagatcataatactgtcatttattggatgtggcaatgctaaattgcccagactcctgcagcctgtggcctgagtttgtcttgaatgagactgtgcctgaacttgaatgtaggacagatgccgtcaagtttaagtttttccaagtatctttcagtcggtttgtgcctctgggaaatgttgtgtgaggtatttaacactctggcctcaccaatccaccttccaatatggactgttttttgactttcttttgactcaagttagacccggatctcagccctcatcccagctccaaatatgtatggtcagaccttttcttttcttttcctttctttttttttttttttcttttctttccctcccttcctccctccctccctcctttctttctctctctctctctctttctttctttctttctttctttctttctttctttctttgtttctttgtttctttctttccttctttcttttttgagacagagtctcactgtctggagtgcagtggcgcgatcttggctcacttccacctccatcttccagattcaagcgattctcctgcctcagcctcccgggtagctggaactacaggcgcccagcaccacgactggctaatttttgtatttttagtagagacagggtttcaccatgttggccaggatggtctcaatctcttaacttcttgatttgcccccctcgggctcccaaagtgctgggattacaggcgtgagccaccgcgcccggcaggtccttttctttttctttctttcttttttttttgaaaaactaaagaatacccaatcccctcctcaggtggctctatcactgcctcaccctgaggacagtatttccccatggggtttggatcactgttctctagttccctctccctggggcatgtgcagagtttcaacttcttgttggctgctctcttccactcaggatttaaaacattcacacttgattctttttccttctatctctgtaatcctaataccaagttttcttggcattcattatcagccgtggaatctgttgtacctgaattgttactcacagcaggtaataagagaacaagacctcctggaatttctgagccagactttgtactcagggttaccttgctgacccccatattttccagcattgctcttattaattaatggccctcagtcctgcacacaccatcagatcccaggggctgagcacagcctgcattgtcaggttctgcaacaacacaaaggctccctcctctctcctatagagggcgctccagggatggtgggtgttgccagagacaccagtaattctgccagaccttgcctgtggggccatgggagctcaaaatgcccctcctttcctccacaggaccagatgcctgagctaggaaaggcctcattcctgctgtgatcctgccatggatacctggctcgtatgctgggcaatttttagtctcttgaaagcaggtcgatgcttagactctaggaaattcttgctttgaacttacctaagacaattctaaaccattctcttaatcttcttcttttctcacaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgaagccacagccttgcaaagacaactccagcctgtgcaaaatccctcacagagctgcctccctcccagccgccagctcccacttcctgcctaagaaaaggaagtctctggttgggtttgttcttgcagctgtctccaaatagacagatatctgaaattaaattaccaaaggtatcttgggcagaaatgaccagacactgtaggatttgaagaatgtttacagatactacagagtgtgagtgtgatggtgggctctgaatatgagagaattgtacacaaccaagtaacttatatcttctcctcattcccatttggccatctttattagaattgttttgttttagttgcttaggaaaacatattttaacttctagggtggcgagatgattcctgagtgggagttcaggtatttccatgagaatatagagggtgctcacagaaatcttcagaagaaggggcttggtacaaagaactcaattatcaatgactcttgctcagcatgtggtcaagagcagaactatctgatgaccctgtgaacctggtgtgatgcatttgggctaatgatgctagctcacaaaataacaagttaagagagtagaaaacatggagtctaatatttcacaccatttcaaggtcaacagagttctagaccagcatgagaatcgccagaataaagcaaggcagtgcaggaacagaattcagcagcaaaagtcaagagacacctagaggcagaggcaggaatgaatttgtcactttcaacttaacctgaagcagccagattaacttcttgagtttcatttaagaaattattcctcttttaaacatacctattgaagtctaaattttaggtattttatatatttcagttctggaatttccatttaaatcttgctacaatttccagttgtttgctaaaattgcacattttgtcatttactttgttgactatattaacatctgtcattttaaagccactttttgataactttaacatctgaatctgtttgggtctatttcttttgtctgttttctctgttcagtttctgggcacgtgattttgttttctcatacaactagtaatttacttgaatgccggatattgtatataaaaactatagagataatttgaggctctgaatgatttcatcttcctcaaatgattcacttttgcttctgctgggattgtagcaggggcggatcaccttaattgagctgatgaatgagctggatcagacctgagcttcagcctgcatgatggctgctcgcctttgctcttagccatgtaagttccaactagatgtctgaagtttaacagctaaatcaaattgtaaattacataacataatatttgcccattgcaagcatgcaattcaatgaattttgataaatttgtggagttgtgcaacaatcaccatgatccagctctaaaacatttcatctttccccacccggaaagttccttcgtgctcattttcagtcaatccctgcttctacccccagcaccaaggactggggtctttgccaggctcctctcctattcagtagtcactgaacgtaaatgttctccagaccagaaaggtggtggatgctcctcaaagcctgctacactctcagtcttcccttttcttctcagctacttagccaacgatataaaactggcaaatgacttaaggcgaaagtggtctgttagatctctcctttctcgttgagatcccaatcccttaagttcttactgcctcagtagctccaagtgccttcaaacgtttatttttatattttgttaagtttttctagttgtttttggtgggagtgttgttctgcaaaaaatcagtctattaactctgaaagccagtttctatatttattaaaggtgaggtgcaatgttttatgtttttattttaggtagaagtatcttgaagaaaggaaggagtgaacctctctgccttcccttttttttttctttttgagacagattctcactctgtcacccaggctggagtgcagtggggcgatctcagctcactgtaacctctgcctccggggttcaagcgattctcctgcctcagcctccggagtagctgggattacaggcgtgcaccaccacacccagctaatttttgtatttttagtagagatggggtttcaccatgttggccaggatagtcttggcctcttgacctcatgattcgcccgcctcggcctcccaaagtgttgggattacaggcatgagcctccattcccggccagattatctctatttctaagagttctattagccttctgcctttggtccaccatgggacagagtcttgacacgtttgaccttttaccacaaggaggagctgtgactctactgagattaagggaactcagaggaagggcagagcattctcaggatgggagacagttaaaagaaatattgggtttatttacaacaggggaaaatgtggtctgcagaagctgtgttaatgctgaaatgtgagaggataaatatagactattcatttgccttgctgtgcaggtgcttttgatctagcaaagagcctagactgccagatttgttgcatgtgaacctgcatgggatgagaaagggagagaatttgagctgggaaagagcagagctcacaagcagatgccagtggaggaactcttcctgagaggaataagagaggctctggatgctgggcctcttctccagttcaatcctgccatgaaatgacttcctggaacctgggcagtgagcctgacaaatcagggcttccttgagggatcttgcaaagagagtaattaccaagggaaatctacctatcagaccaaagaatacctggagcaccattctcctgactctaaatgatgaaaaacctaagctagaaagggtttttttttttctttttcctcttctgaatgttcctctaagttcttggagtgagggcttcttcgaaggataggaaacctgtctcctgggtctgagctaatggttctatcaaaacagcctcaccagactcccttccagcttccagcttcaatatctatccctgtctaccaagacccatggaagctagacttgtccagatatcaaaagatgatgccaaacacctggagatgggaaagaaggtggcgtggacagacctccaggatgcacatctgaaacaggctcttcattttgttttgactacagcctcctgtttcgccttttcaaaaagcatttggaatttcccttacttcttggaaatccaaaaatacagcaaagatacattttctataggctctagttattcagtaggagggagcttcagaatatctctatactctactatgcatattctagcatgctgcccggaagtgaaagtctagccaaacagtttaacaggaaaaccgttagctgtcctgtggaggttaattttgcagtttattttggaatggaacaaaagaaggtattgaagataggaatctcatttctatatgctagaatctaaatttcttaactttctgtagtatgggccattttcaaatcagctaaagtcctaaaaccagactatgggaaacacacacttctaagctcaatattaaatatctaaagtgactaactaacgtagggttggagaggcagggtccccctggacttttcaaactcctaccctcacaaaaaatctagaacttcttctcagtaacaaaaataagatgacgtataatcatttttcattgttaataaataatctctatccatcatggcattgcattgaatttgtgttaattgttgctaaaaaatgactgtgggttaaacatttgtgattcatataataatagaaataataaatgtaaatgttttaagtgaacaagtgagattttaatagctcaacaggcaaatagcatgaactgatgctctgcaaaggtgagggacacctggcctgagacaggatgtcttatctgattttggtctgaatttcatttggaaaactggcagctgctggtcaacctgcagggatatgatcccatgagctgatatgcaatgttgacttttgtatttttgtcagcatgaaataatttttttttttttaaatcagggtcagagtctcgagtaactagcagccagctgatagaatggaagtgaaaccatggccctcgtccccttgcaaacctggaaacccagtgttgagcatgtgtgaagagagaaacagaatcaggtgaaatgaaatcttcctaagaccctgctcaggaaactaaatttgacgtaattggacacaagaagttgttcatccattctattccgccagaggagacaggacagatttcccgtgcgttcttgggaagctggaagagggagacagctctgccaggtggagtgatattctcatgagaagtgaaaaagaagaggcagagatggagagtttggttctagaagggtggaaggttttgcttataaacatatcaacacacttgcttttcccgccaagatgcaaactttggggaattgctcaaatataagatggggtttaaatattggacagccaaaaatatgacccatgttcaaaatatgcatcctggtatcattcagttcgacgtgttctagttcttctgcagctttctgtctcattccttttgcccctacaactctccacctttttgtggattaagttatctccatgataaaattattatgttgtcttccctctttgactttcttgtcggcagcctggctcttcccagggatcccagcgtctatcctctctcctttctgtagcttttttccgcttctccagtatggcgggccctgtcagaaaatacgtacataatcaatttatttgtccttcttatcctttggacaattcttttgtttgtttgtttgtttgtttttggttgagaccaagtctcgctctgtagtccaggctggagtgcagaggcaggatctcggctcactgcaagctccgcctcccggcttcaggcctgcctccgccttcctagtagctgggactacaggcgcccgctccacgcccagctaattttttttttttttgtatttttagtagagacgggtttccccgttttagccaggatggtctcgatctcctgacctcgtgatccgcccaccttggcctcccaaagtgttgggtttacaggcgtgagccactgcacccggtctagacaattcttgatggacaatcaaacacttttgcttttcatatctcctgtaaaacacaaaacaaaacaacaaccagaactaacattgcctcatatgaggcgagtttctttctatcagtttcattccagtgcctctcccagacgctgtccgtctgatttggtaaaaagtcttgcgtaaaatagtgaaatacatatttatttaaagtctactctttaagaatggttacatctttacatagttatgatcatcaccattgaatgtagcctcttgtcatttcactatcttccctccccacccgttccttctttgaaaaggttcccatgtcagctgtgtggtgcaatgtggtaggtactgaataagacccacaactacgggggtacctggttatgttcacagaattgtagagctagacagagtgttgaaaattatttatttctgcccattgtttcatagatcaggaaatgggatgctttaaaaaaagtatttaaatgtaaatagtaactattttgctggcctccatgtaatatgtatttcatattcttagtctacaagtaatgtgtgaatgtgtttttgctcctattggattataagcatcatgagagtgagaatattgtttactcatgctttgcactaagtagccattcagtgactataaacaaataaagcatgcttgaagttccaagaaggatggtggtcatttttcttttgtttagttcaagttctgtgtttagtaaatcacaaatgaaccatcaaggtctgtctttgcaggggattcaccagtagatgacaacactaccaaagtgtgtgtgtgtgtgtgtgtgtgtgtgtgtgtgtgtgtgtgatacctttctggcagtgctggtctctggttttcctcctggaggttcctgccctggggccattgactgaggcactgaggtctgagtgctggaccttgctgacaagagcaggaggagctgcagccctgccacacccccgaggttgggtggttgatggctggcagaggagaggagtaccatgggcaagaataaaggggactgtggtcctcaacattagataattcacaaaacgcgaaggcattttctgtcgtcacattgccatcaggtgggtagggcccaaggatgccgccaagcatcctccctacacaggacagctccccacaacaaacaatcacctgatccaacatggcagtagtgctgaaattgagaaaccccgcaataagcttcggttgtaaactttgtaccaagaaggagaattctctgcagacaactcaaggggcaataccgtcaactacttttgttttctctgactgccgtgttgttgaccttcatcgccattctttcccagcacatggtgtctgcatattttccagcagcctcctgtttcctcataaatctgccccttggacagataagaacatcacagggagcagggctgcagttcactcccaataataacgcctcagcagggtttgctctgcagtagcatcacagtcatgtggagtaggtggctatggctggtattcaggtgaaatctcaggccaatctctcctgaatcaaggggaccactgatcattaatgagaccttcaagtgagcaaagattcaagagagcaaattaatgtcctgcgctattgtgaagggacgcaaaggatccagagaggaaaccagctgactctgagagaagggcctgaaaaggagaggaagggaggaggtggtcagatccccgggaaggagcagggagggagggggctgctggcccaggaatgactgtcagagacacatcctggaggtcacaattccaccctctcaattattcccagaaattccaaaaactcctttaaaggagcaagtgcagggcatgaaagggaggagccatgctagaggagaccctgggaatgggggaatgattacaggctgtgacctcactggcgcagcacctctcagcggcagtggaaaccacagcctagtcctctcaccactgcagaccagaatcctgccctgggccttgcctggtctgcctcactctgccatgggctgcaggctcctctgctgtgtggtcttctgcctcctccaagcaggtgagtcccgggcccaggtgacatgatcctattggagtccctaagccttttcaccatgacaacaacagcaggccgtctcctaggatttgcctgaattctgcttctttcctttgcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccaagacacagccctgcaaagtcactgcatccctgtgcacaaacctcccggctcagccaggaagctgcagggcagcgtgtgcacctgcacccagggctccagtctccattccctgatggcctctgatggagtttcagtctgtagtacagccagctagtgcacccagtggagaagtcctccatcttatgcacacaaaagtctcacagaattgtttatcagctagagcagggcttcacaacaaagccactaaagtattagggctccacaaacaaaaaagagcctgtcctatgcactgatgatcttaactgatgggggaagctctttcttttctttctgtgtggcacatattggtacgtattttatataacattatgaaaaaaacacgattgctgaaaatggttgatgagcacaagcataaaggagggggaaggaaatatttccaagatcaagagacaattctgatgatcagtgagtactttattcaacagaaaaatatttggagaggcatgaaattccatggcaataggtaaactggaaagtgttgaggagatgccggtggaggtagccttgtgcgttgtgggctccttctcttcaagaagggtgaccagcaagtgtctctcccaattctgatgaatatcatcttgaactgtcctcaacagcaggcaatagccagatgactggggatattgggagacctgaaaggactttggacacaaatctctaggcagtggtgagccattggtcctactccaagtgaaacaacatgatgaaactgatattttggtagaggaacactggtagtagtatggatcagaaaggagatagatttttgggtggcatgaatgattaggagacttctaaatatcctacatgaaagattagaaagggttgatgtgaagcattgtggacaatataggcttgaggctctgcattatgttatttcttggaaatgtattgggttttattctgggagggttgaatgtaggacttgctagggtctatttcagccttgccctccctcttagggagccccagcatgtggtcatcattgctagtgcatggcctttccagggtcttagtgggaatcacagtcacccaccacgactctccactctcactgggtctgaatgccattgccttcctgccctgggtatcctctgaaatccctgcccgtgtctacagccttccagagtttgttctctgctgggccttcgggagtgccaccctctgcatacacaacttaggacctggcccagaaagaaaaataaaaaatgaaaaaagattttcttacacaggttctcagggctccttggtagtactctgtgtcctaaatcccagctgtcttggagtcagttatgtcctcttatcttcaatcacatatactacttctattttatataaatatgtttacttggcttttcttcatatttaccattccactcttcactcttcttgcaattcacatggtcctgagatcattttccttcttagatccatccctaattcagaccacttgaactcgctggtcaccaccccttgttgtgggaaatgcttatgttagctgttgtcctcaggacaattaaacctttcgctttcaccattattcaagttttcagtttaaattctattgctttttttaaattgtctttgcaatttggtttacttattgagagccaaacaatgcaataaaattttattcgttcaaatttgttctactttgtagaagggccaaagtgttttcttgctgaagtagataccaatggaaacaattttaatggtaataatactagtgtttaaaataaggctaattttaggtttttatctagtgaatagaatatctccaactgtagcaggatagagatcgatcctatatgtaacctgttgagggggagaatactcaaccccattaaattctaatctacatgctttacattttttgtttgtttgttttatgggccacattgaaaatctgatgaaatttttgcattagaagaatgctacaattttcctcctgactgagaacatccccaggttaaaacaaatctaaattataaatccttgacttaaatcatggataagtatcttccctcagccccatgtagatttacatataacatagatttacgaccctaatctcatgcctacaattataattatcatcatgaaaaggtaacactgatgtaatacaacaataaatagatggtaaaaatcactttgaaagtatgaatcatctcatttttgtgtttatttgtgttcatttgtatctccaaatgctctagaatgaaaagccaatattggcataaaagtaccttttaagaaaattgatgatattccaattcttaactggtcacaaagcataaatagcttatgcagtgaagtacagaagacccataggaagtcatccagctggttcctagttggaaagttctccacagaactgatgaactaatgtggtttctaacatcttagaaatggcagggctttagagatcatctcatttcagttctcctgatttaatatatgaggaaatatggcatcacatatatgaagtgattgaacaatgacatactgattacatttctcaaactttatgtaagatatatttttattctctagttgttttctgaatatgttgaattgccttacacaaatagaattctgggggtgaaaatgttggtgattttctgcttgctcctagctgttgctcaaggagtatttgttgaacaagtcagactggcccaagaactcaagagggctgggatactgtctgttctgcacattactagagatccaggcatagacaattttctgttcttttttcttttctttatttcatttcatttcatttcttttccttttttttttttcttttgaggtgtgtggtgggagcagggtcttgctctgtctggagtgcattgacacaatcatggctcactacagccttgacttccatggctcaagcaatcctcccacttcagcctcttgaatagctgggactacacacaggcaccactacattccgctaatttttgtagagataaggtgttgccatggtgcccagacacagacatagacaatttctgttgagtaaaaatttagaatgtcttatgtgtgtggatacctggcgttctggctgctgactctctgtgttgttgccaacacctccttcgtcttcattctcccctggcctttcaaacccttctctgctgctcagggttgtgagatgtggaacccatctggatgctgacactgggtcggtgagtggccaaatactgttttggccacaggcaggagctgtgctctggtgaaacctctaaggcagggacctggggaagggatagagaataagaggagagatgggccaggagggatcttgcccatggggagccaaccgtgcctcaactgagagcatggctgtactcagcccaagcacactaacatcagcttcaagctgatttccctttcctttgctccacacaccttgtgttgttctttttcagcatcctgtgtatgttagctctaagcccagccaagccccatgccctccacttcagggacagagggtggctcatcccttttgtgctccctcagctccctccccagtgcctggtggctggttggcaacacagtcatgcccttgaatgatgggagctggtgcacactgcatccgtgttcatgcagtcaccctccctccacagagccgggcagaaagggctccaccacacttagacattgagggaagggacgttttgaatggcactgttttatgtgatcccgcaggacagaaggagatttcttgaatgggagtggtctgttgttgagagggatcctgaaagacagggagacaaagatagagggaggatccacataattaggaagcagctgagagcaaaggagcccctgccagaggaatatccttggggggtaaaaagccagctctgccctttctccccagccgattcatcctagcccagcaaattcaaatctaccttctatcagaacttagaaaggatgtaaagcagtcaggaagaaacatcccctgggtctggggaaactatcaggagcagtgacatcacaagaaaaaccaccaaccagggccaaggagaccagagcccagcacctcgcccaaaggaccccagtcagaggccccatctcagacccgaggctagcatgggctgcaggctgctctgctgtgcggttctctgtctcctgggagcaggtgagttaggttgaaattgtctgtccttggactccaacccttttccttgtggctgcaggaacaaccctcttcctgggctctgcctgaattttgtccctttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaagacacagccttgcagagtcaccgctttcctgtgcagaaaccttcggggcctgccaggaagccgtgggggccacggagggctcgggtgaacatttcctccaagagccccgaagaagcttcagaacatcatagcacctgctaattcatccatgtggcaactttacatcctatgacatatttagagtgtgggtttccttttgcctgagtgtgactctgccccgtcaactgatttgaaaaaagagaaacatattcagatctagtttaaaaaaaaaaaattttttaatcatgaaataggccgggcatggcggctcatgcttgtaatcccagcactttgggaggccaagacgagcggatcatgaggtcaggagtttgagaccagcctggccaacatggtgaaaccccgtctctactaaaaatacaaaaatcagctgggtgtggtggcatatgcctgtaatcccagctactcaggaggcaggagaatcacttgaactcgggaggtggaggttgcggtgagccgagaccgtgacattgcactccagcctgggcgacagagtgagattctgtctcaaaaaaaaaaaaaattcctgaaataaagcaagcatgctgtaaggattgtgtagcttaaaattttataagaaccctctaaacaatcacctgtgtcaccacagaggcacaccctgcactgggtcagacactgtcctgtgaggagctgtgttctcctgacacttcatgtccagtggtttccatgactcttctttggggccaagggttccctttcatcataggttgttgtcatgcagagtcaagcaacactgagcactgggaaatcagagaaggaacttccaggcaagggtcccagtgcagaagccagctagagaggacagtagtagactcaccctttgggaaatatgtttgagaaatatgtatctattttcaccagttctattactctatattacagcttgtctattctctaatttctcatttgtacactgaaagctagactgtgaattctagccctgatcaaagctccacatatacacagacaccttctctgaaccctgcaggcagcaaacttgcctctgtctgctccccttgctgcagagtccatggatcatggtctagaagtttcctgactcatccactctccttctcttggctggaagcctccttgttggtttcagatctcagcgcctccctggattgcctctccagactgacacttgaaggattatttttccccctttggtctctttattcccaatgtgttcaatcatcaggctcagagcctgatgcctccagagcgcagctctacattagcttttagagaggagagtgggtcctggctgttctgtttatctgttttcattcactaattcattcattcatttattatagagacaaaagattccctatcccaagatatatggtcatctgtgctgtatcaaaagagaagatattcttctcacagttttatgaaatgaggtagcttcgcaacttgcggggagcagcctcttaagttagttgtcaaaattaggcttttgcctaagtaaagttaggatcctaaattaggctcctactctcccacaaaaactgggagacagggcctctatcttccttgacgattgtatctcaaaaagatggttcctagagtcttgggaaagacattcctgggtcataaagctggctagaggtttacagagattttaataggattgtcaaaaagccttttctgtgtttattgagatgatcatctgggtttgtttttagttctgtctatgtggtgaatcacatttgttgatttgtgtatgttgaaccaaccttgcatcccaggaatgaagcctacttgattgcagtagataaactttctgatgtgctgctggatacagcttgccagtattttgttaaaaatttttgcatcgaattaaataatttttaaataaggtgacttacattaattgctttttaaatataaaaccaattatgcattcctggggcaaatctcatctactgattagatattaacctttttatacattgtgagttaaatttactttatttttgttaaggatttttgcttctatgttaatattagtactatttattcttcacaatttgtaaattgataaacttgctcaatttcatcaataaagtaagctgggcctggagttttctttctggaaatgcttttaattattatgagttcaatttttaaaaccacttctacatgtattttttaatatccctatggacattcaagttatccactttttgagtgggtaattgtgttttttggggaatttgtttattttgtctgcttttgaatttattggcataatattaatctttcattggagttctaatttgcatttctctaaggattaatgatgttgaggacattttaatgtttttattaccatttgcagatatgtctttttcatatacctattaatgcttttgcccagttttaaaggttaaattatatatcttttatattgatttataggaatcctttataaaatataaaggatttttatattatatagaatcctttatataatctggatacaatattctagtctgatatatgtattgtgaaactttttcctcagtctgaaaattttcctttccactttcttggtagtacctgggcacaacccctatgaaatgagagtacccttctgtctcctttaattttgtctctctaccttcacccttatcagtatttggcaggcaattaattcagtcagattgagagagtgcaaaggcttctagctagccctcacaacactggcttgggtacacctctaatctccaatcacacgaaacaatttgccagcccagaagctacccctgctatgtattctaccatgagtagaccttaaatgtgcacctcccactctctccatagtacatatggtagaatggtgatggatccttcttttggcagactttccacaatgcatggagctatgcctatccaagcacatctctgcatggacaaaggaaggggtggataattgagtcagtgtttctgcttcttgcttgtgagttttccccagtaaatcttgttttatgtgtatattgcacagggctagtgctgtctacatgtcccttcatatgatggtgctctcacagaattctgaggctggaaggaacaaacaaaagttctcataaagagaaatttaatcacctctagaaagaagtccgtgcttaatggctttggagtttctgtgaagaaagggtttcctcctgccttagaaggtgggcaaagtgagcaacatcttcaccaagtcaggaacacttgatttcagccagaggcagaagtggggttctatgataatgcccgattgtggttacagagggactacatgagcaaggccatggaggtgaaaatggattcatttgggctgaaatcctgtaaatgaagtaagcgggaaaacccagcgcacattccaatggaagatgcagcttcctaatattgtgctttcaacttagattctgtcatctgtaattactccacacactttctcaaatcattagcacaactgtgggccaggtaatcatttagcccctttgcttggtacaaggtagccatgctctctacttagctccctatttttctctgggaagcttttgctgagacctgcagtgaccatgcttctcagacttctctctttcttattgtcatttccatttatattttaactttaattgtagtttatttgattaacatctgacatgtttatgtttctcttttgcttatttgacctcacttaatgataacccaggtaactggtcagctgctgctaatcaagttatattttctggggttacattggttattttttcctctaaagtttctatctgtgtaagaattgaggtagcagaaccttctctctcttttttttttttgagacagagtcttgctctgttgcccaggctggagtgcagtggtgcgatctcgactcactgcaagcttcgcctcccgggttcacaccattctcctgcctcagcctcctgagtagctgggaaccttctcttttttggaaacagggtctcactctgtcacccaagctggagtacagtgatgcaatcatggctcactgcagcctcaacctctgagattcaagcaatcctcccacctcagcctcccaagtagctgtgactacaggcacacaccaccaccactggctaacttttttgtttacatttttggtagagatgaggtcttgctatgttgccaggtttctctcaaactcttgagctctggtgatcctcccgcctttacctcccaaagttctgagaatacaggtatgagccaccgcgcttagctcctcctattgatttctgaaatttaaatggagatcagactgtctccacgcaaggaggaagtcagacagggcagagcttaaccaatgtccacggtttgttttctcactgcagtcttggacttaccactcatctcttcattctctggctcaaaatagcttcagtcttcccagaagattctcatgattttcagtttgtttctggtttcttagttatttcttgtctcatcaggctcccctgaggaaggagccaggagatgctacaagtctgcaattttagggggagtcagatggagtgcactggtcttttgcacttctttataatattatctaagcctcctcttctttgaaatataatggctattcatcatgggatatgaggcatctcagaagcaatctaaatatctgtttgtttctttttctagtaaagaattgaccagtattctagcaattttattttaggtattcctttaaaagtaaaaaatacatagtttttcttaacgtgacttctattgatagtttatatttttatgattttgtgtagtagctttaccttccctaggatcagaaaccacatcagataatcagcttctattatgaaagaagctgattcttctatttggagagtgaggtatgcagaaaatccataaaaggtattaagttatagaacaccaccatctgatccaccatctgatcttgagagaattttaactggtttatatccatgaatactccctcagtagggtatttttgttctctggatggcatcttggaagaggtactggtcattgatcatatctcactggcacattggctagtgaccgctaatgtcacatgcagctggattggaatctcttctcattgctttctcatggggtcatttgcctttggacttaaaaatcaagaaatttcataatgacaatatctagatttactgtatatatgtaactattcttaaaatttgataacagatatgtcaaatgtagatatttaaagaaatttggattggaaatacactaaatcagaagtagcaagtgaaggatagcggttctgtaatggaatctttctcagattctgttttccctagtctcatgtttcttttttaaacccagtctggcctctccttcttagcttactaagtatagaaccacaaatagaaacttagaaatttaatcattttctgcacatatctttactcatatatgggaaaatgggcaagaggatattgtcagtgaactcaggcaaaaagaggatttctaaaagagagagtatagatgggaaagaaacaaattccccagcagcatgggaacagtgggtactgttttgtttatttttggataagctgattagttggcatgtagcacagagtggtctgaaaggtcttcttggagcaagctggctggagtcatcacagaaaaaagaactttaataataaatcatccacaaatccctgagagtctgcctgccgcaagggagacgggatgacttgatgtgattctggcacagttcttcctgcagcacacctacctgagctaggccaggtttgcatcatctccttcatcagcattttctcaaaggcaacatttcttttctatcacttttttcccttttacagtgcaaaaagtgatcttgaagaacataaattttaaaatgtgggggtttcttttagttcccctagagaaacagtataatagtcaagatggtgaaattgttcctaatttaaatatgtcccatgtctcttgcaccatgttagaaaggctgtatccatcagctcagacagccacagcaaatagcacagactgcatgggttaaatacaaatctttttttttcacaactccagagcatgaaatggggatgccagcatgtggggctctggtgagggccctcctcttggcttgcagagcaccctcttccagttgaatcctcacatggtggagagagaacaagctagccatcaagtgtctcatctcagagggcattaatcatactggatcagggctccacttttataaactcatgtaaacataattttctctataaagaccctattgtcaaatattgtctccctgggggttgtattttggagggacatcaatattcagtccactaacaatggcaaaatcttggttactgcacagtgggccacatgggggtgctgtggaaccactgagctccaaatgtctctggggcatgcacagagccaggagcctgggacagggagggttaaggagcagccttgcttgatgtttgtgctcactaaaaaatgtgatgacggatacataaaactgcaggtgtgcctctcatcagggagccatgcacttcagctatgcctgggttaggaagcctctgtgagccgaagagggagaatgaagatgggatgtcccatgctgggatgggacaacctgcatgtccagggcagggacagatagaggaacaactgcctggaaggaaaagcaaaggaactgtgggggggacatgcagcctaacctcagtccagccccacatggtatgtgagagtattaacagcacaaagcagaggtcctggatcgggtaagccaggggcctaacaaggaaggcaggatgcatgggaacccgcagagatgacatcagagtagtgatatcacagcctaacatccgatcagagatgcaatgcccaaaaccccagctctcagaggaccagtatccctcacagggtgacacctgaccagctctgtcccacctggccatgggctccaggtacctctgatgggaagacctttgtctcttgggaacaagtgaatccttggcacaggtgggatgtctctgaagcacgcctcatccaaggcaccctcaggctccctcctgtgttcttgccctagcctctgtctccctccctcacaggcccagtggattctgctgtgcagaacagagagcagtggacctcaggaggcctgcaaggggaggacataggacagtgacatcacagtatgcccctcccaccaggaaaagcaaggctgagaatttagctctttcccaggaggaccaagccctgagcacagacacagtgctgcctgcccctttgtgccatgggctccaggctgctctgttgggtgctgctttgtctcctgggagcaggtgagtccctgcagacaggatagcgccccattctgagcctgtcctcacccctgtgtcttccactttaccatggggaggcaccaccaggctgtctccggtgctcattctccatctgcttttcccacaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcagcttggcacagccctacaaagccaaccacattctgtgcacaaacctccctggcccaatgtggagcaacctcagccctgacatatctgtgagaacctggggactgcagggagaaagaaaggcaatttagaatgctaggatccacagcctggggctttctgcaactcagggctggggaaaacaaggccaagagagcctgctcagaggatggtgctgcttccgtaggttgactgcagcattaccttctttgccgacactgtgaactacaggagtagaggaaatgtgtgtaatttaacagctggcgcactctttctcaggacaagagatttaattttgtggtcaagattgttgataacagtgtagtgtagaagggagaatcacagggtttgctttatacaacttggggagaagaaattgaggttttgggaaagtcaaggagagagaaaacgaaagatgattgaaaacagagatagagcagaaggtgatgaaaagtggtgttctgtgcaccatgaactctctttcccccacccgaaagttttcaacacctagaaaaaaataaggaaaggtcttatagccaccggaatcacctggtagccggtcccagtcggaggcatcaccaaattgccgcttggccattgtgagagccctggagttgcttctgctgtcttccttcttccagccctgatcttgactcctcaggccacagtcaggtacttcccaaaacacagaggaaggtaaagtcacccttcttcctaaaggggcaaatactttccagtttccccccaaataaattctgcaaccctgggattcctttctgacactcacctcccaaatccaattaccttctatgaccaaatgctctttgaacattttctaaaactcagcagtctctacatcctctgcgtttgtccttacagtttccatggcctgggaggacctttgttctcctaagacggggccacatactgatcatctgtcaaggacaggctcacacctgccttcctcttcacttcttactgtgacattccctgggactgtactgtatcactctctttcctttattttaaagccaagcatacaattgatactctttgatgtttgcaaaactaataagttattgccctctcatacagaatcctggagtgtgattaattactgtcttctctttacaagggactctacatgaaatatcatggagaatgattatgaatagtcttagtatttcatgtaacttctgtaatattcctagcaattgtgtcttcacagtcaggattgatgaccagtgctgtcaagttcccaaagggtatctaatgctggaatttgcaaatgttcttttggagtgaagaaaattatgttatttaggctgactgaagaatcactaaagaaagaaaattatggtacagtaatatttataaagactcataatcctgtaaaaaacttcctcaccataaccacactttccacagccacatttttagagatttggtgagggtggaatatagtcaaaggtgcttcttaatcatccttgatgaaatcaaccaaaatcaacctacaacattgaaaaaaaaaactagctttgctcagtaatggaatcttatcatccttgacaatgaaaagatattatgtgtttgtgagtgtgaatgtgtgtgtgtgttttcttgtggatactcactcacatagaagtttctcccctggtggcattttatgaggtgctggatcactggcagagctcctaggcacttctaggtaaggatagaaaatagcagacctaacggaatctgcctaagttatagctgataagatagtttatttcaagattttatacattcagaaataaatttgtaaaatcaaaaaatcctttttataaaatgtgcttgctaaaatttgtgaataattaaactaaatgcaatgtgtgaaaagatatgagtctgactaatcaaagggagctctgcaatgtagtattttcagcccagattggcttgatattgtcacactttcatcctgtggcctgtataattctggctcctttcttccatcttatgatgctcattgcaataatgtaacagcaatttcttgtgcaatcaagatgtgtccttttgtctccactggtcaagggtgagtttgaagttccaccctaaatcaacccttccgggaaagcaatagacagggtgtgtgaaagaatgggggctgcaggggttggagtgggggcaaccgtgttcctgacttggactatcctgagctcatcaggtcagaaggtgtgaatccatgggactgtggaatgttggccacttgggggcgctgtggccccactatgctgcagggaaccctggggaggggtgggagggtggccaggaagggagggcggaagggaatgcctggctgcctgctgacatcaggagattaggtggaaattagagtaggtcctggcctgggactgcccagggaaaggtagggccagggttggcaccaagcagggagtgtttctgcctctgcatgggcagaggagggtgtaggggctggggtggcaagggctgggaatcagtgtcaggacagggatagggtgggcagaggaaagtgaggtgtgatgtgggcatgcggggactgtgaccagccacctcccctttagttgaggggctgtgcgggacaggaaggctgcatggagctgctgagcctgagtctttcaatgggtgaacaaggcaggagtggcctgcagaaagagtacctggaaaaggactgtacccgaagaattgggtgacactttcttagctccactcagggagtgaccctgaggagggtgctgccagccagaggggctcaggtcctggtgagctgacaggcttttcctccagacacttcctgttgtttctgtatgtgatctggttttatgctcactgaaatcatgtaaggtaggtatgatttcacctgtttatacatctgaaggaaagcagctgttccgggtctcatattaagtaattggctgaggtgttttcctccaacatctctgcaccagccccgtcccccgactctatatctgtcccttcatctggcttcccctttccaggtccaattagcaggagcacaaggtcatgcctcatatgtgaccattgtaacctcttccctgacaagtccaaggaacacgtgacttccaggccaagcatatccattcacctttcactgaagcaaaacagaaggatgaaattatctgcactgtacacttcctgtaactgatataatctaccttgaggaaaagtaacaagaaaaattgttattcattagttattattttatttaatatatgtttggagatcctttctttgtatagatattttatgacataaaaagcaaaataaaaaagaacaaatgaaaataaaaaagaaaagcttgaaagaataataagtgtttcttactttttagagtattaaggtttgcattaatttttttaacttattcaaagacgtttgctcagtttctgaattatacagatttcctttttttcttctctttttctctttagccacctacagctttttctgccagcttttttagtttaataacctaaggctatcttttaaacagatttttaaatgtacaatatagtatcgtaatctacagacacaaggttggacagcagatctctaaagcttcctgattcttctttactgaaattttgtagccactggcggcagctgcccatttccccctcttcctagcccttggaaatcaccattttcatcttcacttacatcagtttgacttttaggttgcctcatataagcacaatcatgtagtatttgtctttctgtgcctgactttttcaactcagcataatgtcctccaggtttagccacattgtcatgtatggccagaatttcttctttttaatacttaatgatattccattgtatgcatacaccacatttaaggtctgaatattaaatgtatagtatcttattgtttctgcgaaaccatctgtcacaggagtggcagggtcatttgcagaacagtaagcactgagtatatgaatgcacattcattcgaagttcaattctgcttcatagagaagacttcaaaaaaataataatttcactatttattgttattttactatacacaaatagaatttcttttttcttttttttttttttttgatacagagtctcgctttgtcgcctgggctggaatgcagtggtgtgatcttggcccactgcaacctctgcctcccgggttcaagtgattctcctgcctcagcctcccgagtagctgggattacaggtgtgcaccaccatgcctggctgattttttgtatttttagtagagatgagatttcacagtgttagcctggattgtcttgatctcctgacctcgtgatctgcccacctcggcctcccaaagtgctggtattacaggtgtgagccaccgcacccagccaataccccaataccataaaatatttagcatatagtagaaatctagctatttttatttcctttgctagtctcgggcagcctcttccactgcgccaatgcccaaaggcagttaaagacacattttgcctggaaatcttagggtgaggactcaggaagccacagaaatggaaatacatatgcgtgatgattactttgaaagtatgaactagagaatgtagcatatatccctcctcaggcatttaaaactcagtattattgatatataagttatataagcattacacattttaaataaacagatcggttatacgtaaccaaataattaacagaatgaggagctcctgaaaagttttatggttttaaaaggggttgaagccaggtgagctaccagatccacattagggacaattctatctggagatggatattgtgatgaaacaacctcagaaggtcttctaacctggtacagactgattttacgaagtttatttattcattttctttcatttcttttcttatctgctcattcactccaattattttgtaatgatattttggcgaaaattaatcatctttaagggaaatattttgagtttcatcagacacacatgcagctgagctttgtgttcacacactgagtgccctggggccaaacaaaatacggtaatagtgaccttgttgagagatgacgtcacattgggagaaaggttctctttgtgttgacactaagtgtccaattcataaaacctaagccttgagctaggaaatgcccttttctgccctgggaagcaggctcctacattgtgtgtttttctgtctcctggtctagcctggacacagacagtgtacccactcacgaacttgttatatcctggctgtgaatttcagcaccaggtggccctttgctctgacttcaatttctgtgtccttctctcctaaacaccatggatgctgagtgactcagactccagtcatgtgcttttgccaaaaggaaactagcacaagaggaggtgagcagaatatgaaacaaaaccatgtactcaggaccggcaatgtgacttactggcagctctttgctcaaatattgtaaggaagttgaagatcatgacaatgttacagtaacagggatctctttaagtgtggggctctgtgcactaaaatacgggtttttttttttcttttctttttttttttttttttttttgagacggagtcttgctctgttgcccaggctggagtgcagtggtgcaatcttggctcactgcaaccttgcctcctgggttcacgtgattctcctgcctcagcctcctgaagtagctgggattacaggtgcgcaccaccatgaccagctattttttttttttttttttttatttttagtagagacggggtttcaccatgtttgtcagactggtcttgaactcctgacctcatgatccgcccacctcagccttccaatgtgttgggattacaggcgtgatccactgcgcctggcctttttttttttttttttaattgttactgaattagtggtgagaatcctgaccaagggaatattccctatgaaatatgacacttcaaataaaatgagagcgctttttcttatcctggagcctgcctcttctctcctctccccacatccctcacatgtcaagacacctttgtgcccacagatcatgggcagcgttgggctgccactatcatccacacagagagggcagtcagcagcgtgaggtggttctgcctgctgcggtctcaccccaggcacagaaagcaagagccctgggtggagctgaaggtgctcagctgggcttgtcaggagtcccatctgtcggtgaattgaaaagaaacagagcaaaatgactcctccaatggtgatgagcctgcccctgggatttggaaacttggtaacagagaaaaccaatatagacaaaggattttaaacaggattatggtcaattaagcaaattagaaaaggatacttgaagggggatttgggacacaggagtcaaaaacaccgggaagacatgagaagtttccctaagagtctaaattagagaaatatttagataactgacaccagtgtatgaatgaggaattatatcatcacagggataagagttccattgagttacaaactgcttccaaaaaggttaagaaaaactcgtaaggctgtgtcaattcagacaaaggcattcttcccattcaaacggttcaccggtgcatgaatcttgaatttgaccatctggggaaggggcgtggcctctcctgacaggaaggctctggggcccaggcagggagaatgaagtctcagaatgacccccttgagagtcctgttcccctatcaccgatgcacagacccagaagacccctccatcctgtagcacctgccatgagcatcgggctcctgtgctgtgtggccttttctctcctgtgggcaagtaagtcctgggcagggccccatgtgtggatttcaaggcccagcctgtttccattgtggctgcagcatcagctttgttcttctctgcaggtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaagccacagcgctgcatggccgtctcctctctgcacataaaggcagggaggctctgcctcctccctcaccccagactcagtgatgccctgggcagagttctctgcaccaggaaacttgaaaccccatcatcatgggtctgaggcccccaggatgaaacaggatttgtatttcagatccatctagactctcgtctctccctggggaccatgttgcttcttctctctagggttccccccagcccccaccctcatgttgtctctccctggggaccatgttgcttcttctctctagggtttcccccagcccccaccctcatgttgtctctcctgtggcccacctttcccatctgggcagtcaccctccaaggccttgctgggtctctcctcccctcacttccccacacctctccacagcagccatgaggggagcccctcttctgtgcctccttccttcccatcacagagacttcaaagtccattttctctgccctgggctggaggcttcctttctgcagtggccaactcctacctgtgcttcacatctcagcatgatcagccctcctgtgggaagcatgcccttgcctcccagctgagatcaatttttctgttataagcactgatggtaaaatgtgcttgttagtcaacagagttgagcacagttggagttttccagttacttgtctggatatttttctgctcatgtcgattttaaactccataaaggggaaggctgtgcttgttacatttaccaacagctgttcctggaatgaagggagacctgtttcacagataatggatgagttaatgaatgacaggctgattgagtgatgagcgggtggatgaaccaataacaggaacactccaggtccgctgtaccctggcagaaatctagagttaactgtgcctgagatgctctgctatgagctcttcaaagggcactcgcttgttgaacaagcgttggaccattcattgtgcaagccagtttgtcagttcatctaggagtttccaattttaaatatcatatgttcttcaaactcaatgagggtaaagtctacattatacaattctaagttattttttaaagttttgggttaggaaccaaaaaggaaagaagagggaatatctttagactttggagtttttttattgaaaatgtatttatataaatttttcttggaagaacaggtagggaaagtcatgactacacagccttataggtgctaatttctggagaaggtgtcatgaaaaataacaaaaatgagaactgtgttctggagggaacattgtgactgtcctgagagcgtgttctgatcccaggaaccaaacccaggagtgtgtttggcaactcagagtgcagcagacaattctttgccccgtgcatttgggataagactggagacagctggaaaagctatggactggacgttctgcactctcaatgcaggactctctgaaatcccacagattaatgtcaggtaaatatattcccactattaagacaactaaagcaagaaccaatgaagaaaagtgagtagaaacagtaagcaattgaaatgtatgaagacaaggaattttgccataaaaagatataaaagttaaagagctatatttaaaggaatacaaaagcgaattgatatgtgaacatgaaaaagaagactgtcagaaataatcaaggaaacattaaaaaataatcaaagagaatacactaacgattaagattatcattgaaaacaaaatggaaatgaagaaaagatgacatgcttcaaaagagattgttacaggaggtcaaagacagatctgaagaagttacctagaatgcagcacagaaaattaaacaggaaacaagaaaaggtaagggataaggaataaaacacttgtgggttctagtgtattagtgtatatataatattttgttggaacttcccatttttcttacacatgattgaagtgtcacaaagagaaagtagagagaatgataggtgataattatgagacattagctgagaattttcaagacgtgtttcaggacctaaatcctctgtttcaacaagttaaatgaatatgaagtagatgaatacatatgttatggtgaaattgcggaacacaaatgacaaagagaagattttaaaagtagcccaaaagataactatctcccagcagaatagactgaaaggaacagtgaaagtcaagaaaggagattaaaaataagcatcaagtcagaattataattctcattcattaaatattgagattgaggtaaatatatttatagatagagaaagaaaaaacacggtgagtttgtcaccaaggtatcctttctgaattatagttaacaaagatgggaagtggtcccagaagaggggcatgaggtgccgctcgtgagggaacccatgtgatgggacagccccattgggcacgtgtgactggggggatggaggaggctggggcatcaatggggatggcacaggggactctgacttgcaggaaagacaatgagctcaccttttggtgctttgtgttggcggagctgttgacacatcctagagaacatgcccagcagacagaggagcggctgtgggatgaggagataaactcagagatgcagcgtgaggcctccgggtccagacagcatgagagcccaaagcgatgatacatgcattgatgttgttaaaaaggattttttttttttttttgagacagattctcgctctgtcgcccaggctggagtacagtggcgcaatctcggctcactgcaagctccgcctcccgggttcaagccattctcctgcctcagcctcccaagtagcttggactagaggcgcccgccacaacgcctggctcattttttgtatttttagaagagacagagtttcaccatattagccaggatggtctcgatctcctgacctcatgatccacctgcctccgcctcccaaagtgctgggctcacgcctgtaatcccagcactttgggagaccaaggtgggcggatcacttgaggtcaggagtttgagaccagccggggcaatgtggtgaaaccccgtctctactaaaaatacaaaaattagcctggtatggtggtgtgagtctgtaatcccagctactcaggaggctgaggcaggagaatcacttgaacttgggaggcagagtttgcagtgagccgagatcacactgctgcactccattctgggcaatggagcaaggctctgtctcaaagaacaaacaagcaaaaagcaaggaactcataaatatttaaaggagtcatttaagtaggtcctaaaataaatcctttgttcctgtcattgcgtggattgagagaggatgtgatgtcactatgggaccttctgtgtgggaacaaggacatccctcctcctctgctcctactcacagtgactctgatctggtaaagctcccatcctgccctgaccctgccatgggcacaaggctcctctgctgggcagccatatgtctcctgggggcaggtgattcctcagatgccaagcagtctcctgtgtgtgtgtgtgtgtgtgtgtgtatgtgtgtgagatgtgtgtgtgagagagagagagagagagctgactatagttgtttttctcattcagttcccaatttctgtctccacagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagccacagcactactgctccagtgtcagcttggttccctaggaaatggggtttctagaacctgaatgctgacaaataagagttgtatatgtgtataccatgcaacctgcgtttaaaaatgtatgtacatagtgcaatgactaaatctagctagttaacatatgcagtacctcaatccttatcctttccagtggtgagaatacttaaaatgtactctgttagcattttcccagaatacaaaccactgttgctaactctagtcatttgttgtataatagatctttgtaacatcttcgtcttatctgagtgagattttgtatctgttgaccaacatcttcccaacagtccatctctactccagcctttgctaattactgctctagtctttgaatttgaagtaatttccctgaggtctttagctcaacaagatgggggaattttctctataatgatgcttacgttatttttgctttgtttttgtttcgttattttatgtcttgcaatatagtgtttattgtaaatataaataagtatattgtaataaaaatccttcacctctctttgggtaaagctacagttcacatattctaaatttcatgctgtgaccaacgctgacataattatggatcatgggtttctgggagtcctcagagacagccccatacaccaagtttaagatagaatattccagacccagccaggacagaagtgcatggtcctgcatagctccttggaaaattatagttccccaaattcagttattggatattgtggtgccgcagacaccaaacgtctttctctagcaaatgatggtccttggcagggattgttctgaacccattacaattttgccatcatcaaatcactccttgctgttaccttgtgtctcctgggagtgaggacgccccgggcacagatggaaattccctgaccttcggatgctatttcaaggacttcctaagaccttgtgtccatctttttccacctttatccacatgactcctgagacccacgctcacaatagtggaccagctctgattcttaggcttgaacagaattcagaccacagctgtaaacactgttgctgaaaaaagatgtaaaaaaggtgggcagggcttcctacctacactgagggtgaacatacaagggcataaagggaatattttattaatagctaaaaaaagaagaaatacaagccctgctctaatgaaatgagaactgtagcttcacccacagagaggtggaagattttattacaatatacttatttatattcataacaaataatatatttgaaaaaataaagaaaacaaaaagtaatataagcattattataaagaaaatacccctgtcttcttgagttaaagacctcagggaaattaagacacatcaaaagactagagcagtaattaccagaggctggggtggagatggggtgctggggagatgctggtcaaaggatacaaaatttcactcagataggaggaagaagtttaaaaaatcttttatacaacaaagtgactagagttaataacactggactacattctgggaacatgctaacagagttgaattttttagttgaaccaaagcagaatgtccataaaattattttgaatcaaagtctagaagctttcaaaccagttggcatagccttgtgttctgtgatctcagcagcttcagaggacttggcaatcctttctctgcacaaacacccctttgtccactctaagaactagggacacacactcttatcctatcacgaaaacaacaggctgtgctacagttgctggtaactcgttttaagggtgttgagtatggaggattgaacaagattgaaagctatgctcctgagtctgggaatgtgctggaaccagcttgcatgattcagaagagccaaataggcaaacccttcccaaatcctcattgaatgaagccatgatgacagcttgaaatctgccatagtggctatgctgataccataggaactgacaaatgctactaggcatggccccaccctcacagatatccagtttacaaggacatcactggaatgttttctgatacaatgatgatcctattagggcatgtcttatggggccaaaaaggctcagaatccactgtccatctgtttctgctcctagaagccatagtctaagggaatctcaagtgatcctacttctctccaatctccaaattcccttgctctgtgggtctgtgtctcttatgagcatgccaatctgaaacaagacaactatttggaatgtagctaaaggaaacagggaaccagtccattattttcaaattatccttccttgcatgaagtatgcagatgctgcaatcactgaaaacagagatggggcaagcagcagctctgggctgtgagtcactttatactatagtgccccgctattcctctgtggcactgacagaccctgcagcatggactaatttgcataggaaactaagcagcccctgaccatcaggtatgaccctggattcattttgggctgagaggtcagaaggatcatactcaccttaaatattatcctctccaagctgcaatactcccactgtccatcttagtcccaggatgttgtccagagctccagagaatcccttctcttggggcagaatcaccaagcttgctccctccagatttccacagtctccagtgggtatggggcacaggtgccattctgtgtctcaggtagagagaggcatcatgtcaaatgatatttgtagaagagggattcaaattctgaggctcctctccaatatttgacataattttctttgcttcttgtttcattctacaatctcacaatttaggagagtaattcttttgcggttgcattgttgacagcatttgggaaagtttttgtggttaaattaatttaaacaatcattttaatggtgtatttcttctgttcacgatagaacagtgaaagcagtcatttacacatcctgttgatgaaggtgttgtttaaggttcatgatccacacctaactctcaatctagttgaaatgaaaaggtgcagaattaggtggcacgtgagcaagctatgagagaggctcatgccaattactgtgggatttggagggagggagagatgacctctgctctagaccatgctccacgaagaaggagtgggagtttgtccatgggagactgcagaggaataaataccagcagcttctaactggggtggagtgagggctgcgggagcaaatccttggaacagaaaatggtgcatttgagctctcacagaggacagtggaaagaaaagtcatataggccacagtcccccggcaggttctgtttgctaatgatactattttgcaccagtgtgtccttatctcacaccactcctctgcctcttccagaataatctcttccctctccgctgctcagatcagcagatgtgccttgtgcaagttactcatttcacatagcaggccttttgctggtcttaattatatccgtcgttactttccacattagatactgtgtattgccttgcaaatgatcctactttttatattcctatttttcacttgttaatgcatatttgaccccttcttgaaggtcaagatgaccttggaaatataaggctatctcattatctggtcagtcttttactaatctttatttttatcgtaacattgactgtcattttgggggacatgtttgtttatcttgaatttcattgagtttcctcaaagcacgattttgagttctttgtcttaaaggtcgcatatctctgtctgtctagggttggtccctgttttattttttttttgagaaattaccgacttcaccagatgctgtaagctaccgggatagaggaagtttttgtgatttcatagcttgggtcttctttattcagggcagggaattttattttggggtcaagattgttgaaaatggcatagtgaagaaggtagagtcacaggagtttgctttatatacttgaggaagaagaaactgagatttgggaaaagtcaagaaaagagaacctgatcaaagatgactgaaaatagtaatagagcagaaaatgatgaaaagtcgtgttctgtgcaccacgaacgttcttctccccactccaaaagttttcgacacctagaaaatataaagaaaggactgatagcaactggcatcacgttgaggccagtctcagttgggaaaaacaccaaacagccgcttgtctcctgtaagaaccctgaagttggtcctgatgtcttctttctggactctggccctgatcttaactcctcagggaagtcaggtacttcccaaaatacagagaatgtcagattgcccttggttttgaaggagaaaatgctctgtgcttctccccaagataaattctgctttcctaggaatgctttctaacactcgtcatccagatctgattaccttctgtgaccaaacggtttccgaagattttgtaaaactcagcagcctttcacatcctctgcgtttgcactcactgtttccatggcccagaaggacatttattttcccacgacagggccagacactgctcatctgccaaggacgggctccctcccacctgtcttcctcttcacttctcatcccagcattctctggcactctatgatatcactctcttcactccacaggccaaaccaagaatataattggaactgcctgatgtttataacatgaatcaattcaagtccacttacatagacccctggaatacatgaattactatctcctctttacaagagacttctactacatgaaacatactggagagtctttagggataggctcagttttctacacaaattctgcaatatcctaaacaattctgtcttcacagtcataattgatgacttgttctctaaagtacccgaactgtgtttaaagtcagaatttgcaaatgttcttctgagaaaaaagaaaatcattacatcttagtgacatttatccagtctcacaatcttgctgaaaaatatttgtcatcataaccacactttccatgaccacatctttagatatttggtgagactggaaacatcaacaatggtccttctcagaaatcaacttaaaacactgaaagaaaaagtagctgtgctcagtaattgaacctcatcagccttgccaattaaaacacgttgtgtgcatgtgcttgtgagtgtgagtatgttttcttgtggagatgcaaatagtttctgtgggtggcatttactaagcatcactggatcactggtggagttcataggcactttcctaaccccagggagtgatgggaaatgtcacagccactgaatcggcctaagttatagctgatagggttgtttattttaaaattttacaaattcagaaataaatttgtaaactcaaaaaatggggccgggtgcagtggctcatgcctgtaatcctagcactttaggaggctgagggaggtggatcacgaggtcaggagtttgagaccagcctggccaacatggtgaaaccccatctctgccaaaaatacaaaaatttagctaggcgtggtggtgcacccctgtaatcccagctactcgggaggctgtggcaggagaatcacttgaacctgggaggtggaggttgcactgagccgagatcgcaccactgcactccagcctgcgtgatagagcgaagctccgtctcaaaaaaaaaaaaaaagaaaatcaggaaatcctctcttataaaacacatgatgtaaaatttactgatattaatttaaatacaaaataggaaaagattgggcctgattaagcaaagggagccagggaacaatgcagtgtttctgggctaggtgggcttgacatcctcacactgtttaattaagggtctgtgtaattttggctgctctctaagtgcaacaacggtttattttgtaataaaaagattggttcatgtgtccttttgcctcacttggcccagggtgaatttgaagatcaaccctaaattggccttttggggaaagcatagagggtgtgaggatgagggttgcaagggtgggagtggggcatctttgttcctgatttggacaatcttgaactcatcaggtcaggtgtgaatccatgagactgtggaatgttggccacttggtgacgctgtggctccacaatgctgcagggaaccctggagaggggtgggaaggtggccaagagaggagctgaagcctatgcttggctgcctgctggcttcaggggagtggtttgattcagagtggatccagagttaaacacaaactccccactaccagagaagagtagaggtgctggaggcctcagtttgcaccaaagagtagagtgtccctgtgtctgcttgggcagtggatggtgaaggagcttcagccacaagggctgggaatcagtgtcagggcagggacagggcaggtagaggaaagtaaggtgtgatgtgggcatgtggggcctgctctccacccaccaaacctttagtttcagggctgtgcgggacagatgcatggagcagctgagcctgggacctgccaaagcgtgcaaggggcagtggtggcctgcagggagagaaactcgcaaaggccagttcccgcaggaagctccagaaacattcctgcccccactcaggaagtgaccgtgagagacatgctgtcagccagaagggttcaggccctggagagctgataggcttttcccaggcactttctgctgcttctacatgtgatctgctttaatattcacataaattatgcaggataagtattattttacctgtttatgtatctgaaggaaatcagctgtccggggtctcatacttaataactggctgaagactgggtgcagtggctcacacctgtgaccctagcactttgggaggccaaggtgggcaaatctcctgagctcaggagttcgagaccagcctgggaaaatcggtgaaaccctatctctactaaaaatataaaaatttggccaggtgtggtggtgcacacctgtaatcccagctactcaggtggccgatgcaggagaatcgcttgaaccctggaggcagaggttgcagtgagccgagatcatgccattgcactccatcctgagcaacagagtgagactctgtctcaaaataaaacaaaataaaataaaataaaataaaataaaataaaataaaataaaagtctcaagcctgttgtgccaacacctctccttaaccccttctttgtagctctatcctttcacctgctttcccctttacaggtccccatcaacaggttgtgaagttcatgcctcatacgtaatcagtatagtctcttccctgagaagtccaaggaacatgtgacttccaggccaagcatatacattcatccttcattgagacaaaaaaaaaagtgtaattttctggccagccatgatgcttcacagctgtaatcccagcactttgggaggctgaggaggtgaattgtttgagcccaggagttcgagaccagcctgccaacatggagaaaccacgtctctactaaaaataaaataaatcagccaggcatactggtgggtgcctgtaatcccagctactcaggaggctgaggaatgggaattgtttgaactcaggaggtggaggttgcagtgagctgagattgtgccattgcaatccaggctggacaacagagctagactcccgaaagaaggaaagaaagaaagagagagagagaggaaggaaggaaggaaggaaggaaggaaggaaggaagaaaagaaaaagaaaaagaaaaaaaaaggggtggtaattttctgaactgtagacttcctgtaacggatgcaacatatcttgagaaaaaggaacactagtaattgttattcactagttaatttattttattcttttattcaataaacttttttgggggacctactgtgtataagataccctatgtcgtcaaatagaaaatgaaaaagaaaagtatctgcagatgatggcagattttaaaaaataaaaaaagaaaataaataaagaaagaaagaatattttaaaataaaaaatattttttggctatttataacactaaggtctgcatttattttcatttttcaattgttttatgtttattttcaattgttttatgtttagtgtacttagtttttgaatttatatatttcctttcttcttctcattctctctttggtttctccttctctcttctttgccagcttgtatttcttttttatttaaacttttggtaaggacatttaacatgagacctatcctctgaacagatttttaagtgtacaaaacagtatcatagtctacaggcacaaggttgtacagaagatctctaaaacttcctcatcctgcttaactgaaattttatacctgttgacagcaactccgcattttccccaactcccagctcttggaaagaaacattctcatctttgcttccatgagtttgacatggttgcctcatataaacagaaacatgcagtgtttgcgtttctgtgcttgacttgttcacttagaacaatgtcctccaggttcatctatgacacatatggaaggattgtttttcttttctaacccttaataatattccatgtttcagatctgcaggattaaatggatataacatttggctatttctatgaaactctctgtcatgtgagtggcagagtcatttgcagagctgcgagcactgagtttattcaggcacattcacagataaattctgctccatggagaacattcagaaaaaaataataatgccaacttttatttgtcaattcactatatgccaaataaaaatctttcatttgaaaaagttcaattaattagaaattcagctatcagaaaaaaaccttaagatgcaaatgctattctcattttacagatgagggaattggctcataggttaaaaaacttgaccaaattgaagagctattaggatacagtattgggacttcaacctgatctgtccaatttttgcatttataactctgtgctatagtgcatttcatagagagagatgcctaccttcaaaaatcagaatattggatcctacatccctttcagatcaactggctctaacaacatggaaagagatcagtttaccctggagacagtgatgtaaggagagatctctggctagatgccatgacactcagccctgactcccattctaacaccaacttgtaaagacctgaggccattcttgacatgctgcgtttagtttgtgttttgggtttttatttttttctgtaaaatgagatgactactgcccttatgaagagttgtacaaagatttaatatgacaaagtatctagcatatagtagattctagctattttgatttcctttgctaatctcaaacagcctcttccactgtgccaatgagcaaagacaaatatgaacacattctgcccaggaatcttaggttgaggactcagaactcacagaagtggaaatatatatgcttgatgattcatttgatgaaattacctgcagaacatagcgtacatgccttctcagacattttaaaatcagcacaattgatatataaattgtacaatataaacattacacatgttaaataaacagatcaatggttttatatatatatatatatatatatatagacatatatatgggttataaggatatatatgtatatccttataaccactatccctataaaaaggtctctatcacccagaaatctctctcatacccctttgccatgactctctccatctctgacaaccaatgatgtgatttctatcactggagaatacatttttttcaaaaaatctattagtaacattttaaaacctgtattgattaatccttttcaaatacatacatttaagagtgcaaggtgctcctcgaaagttttatggttttaaaagaggctaaatttctgtgagctacctgatccatgttagggacaatcctatctggagataggtaagaggatgaaatagcctcaaaattactttccagctggtggaagctcattctccaaaattatttattcatttttatttatttcttttatcatctacccactcattcaaattatttattttataatggtattgtgacaacaattaatcattttaatggaattattttgagttcccatatcacacatatttaattggccttcaagttcacacactgaatgcaacggcaccaaacaaaccatggtaacagtgactttgttgagagatggtgtcatatgtggaaaagggttctctttgcttttaccgcaagtatccaacccataaaacctgaactttgagctaggaaatctccctttttgttctggccctaccctgggcaccaggctccagcaccatgtctccttctgggttctggcccagagaagttcttggcacagttgtagcacccactcatgggcttgctggatcccagctgtgaatgacagtagcagggccccctttgctctgactttaatttctgtgtccttctcaaataagccctatagatgctgagtggcctgggcccctgccatgtgcttgggctgaaagaaagacagcacgtggggaggtgagcaggagcgaagttgaagcaaatctagaattgacatggaaaggactttggacataaatccctaggcagtggtgagccactggtcctactccaagtgaaacaacatgatgaaactgatattgtgttacagtaacattggtagtagtacggatctgaaaggagatagatttttgggtggcatgaatgattaggagacttctaaatatcctccatgaaagattagaaagggtttatgtaaagcattgtggaagacataggcttgaggctctggattatgttatctcttggaaagagtgttgggttttattctggaagggttaaatgtaggacttgctaggttctatttgagctttgcccttcctcttagggagccccagcctgtggtcatcattgctagtgcatggccttcccagggtcttagtgggaatcacagtgtattcgccacatcactccactgcaactgggtctgaatgccctggctcttctgaaatctctgcccatgtcttcagccttccagaacttgttctctgctcagccttctggtctgccaccctctgcatacacaatttaggatctggctcaggaaaaaaaaaaggggggtttcttacatataatttttgggttcctttttactaccctgtgtcttaaatcccagctgtcttggagtcagttatgtcctatcttcaatcacataaactaacgatatttggtacagacatgtttactgactttacttcacgttaccattccactcttcactcttctttcttgcaattcagacagtcctgaggtcattctccttcttcagatccatctggaattcagatgacttcaactcacctgtcacccaccctatgctttgagacatgtttatgttagctactgacctcagggtagtcaagcctctcattgtcattgttattcaaggtaggttgaatcccactaaaaaacaaaaatccttgaaatttggtttccttattgagagccacacaatgcaatcaaattctttttaattcaatttttttttcttttttggtggaagggccaagaactgtttccttgctgaagcagactcctattataataatttgaatactaacaacattaacctttaaatcaggttgatgttaggttcttatctaagaatgaagtatatccaactgtagcaggttgaaggtctctcatatatgtaacctgttcaggacgagacaattcaaccacttttcttaaattctgatctacatgcctttacattctttgctttaagggccacataaaaatactctgaaacaatttacacatcagaaaaatgctaacactttcctcctggcccagcacatctccaagttaaaaaaatctctaaattatcaacccatagtttaatcatggtaactcccttctacccccaacatagatttttatgtaactgatttgtaactacaaccttaaccgtacaatcacaattgtcattataaaatactaacaaacatgtgctattaacaatggatggttaaaatcacttagggattatgaatcatttcatttttgtgtttatttattatgtcagtttcaacctgatttccctttcccttgttccacacaccttgggttgttctttttcagcatcctgtgtatgttagctctaagcccagccaaggctcatgtccctccacttcagggacagagggtggctcatccctttcgtgctccctcagctccctccccggtgcctggttgctggttggcatcacagccatgcccttgaaagatgggcgctggtccacactgcatccgtggtcatgtagccaccctccctccacagaaccgagcaaaaagggctccaccgcgcttaggcattgagggaatggacattttgaatggtgctgtcttgtgtgatccctcagaggagaaggagatttcttgaatgggagtggtctgttgctgagagggatcctgaaagacacggggacagagacaggggtaggatccacataatgaggaagcagctgagaacaaaggagcccctgccagaggaatatccttggggggtaaaaagctggctctgccctttctccccagcccattcatcccagcccagacaattcaaatctgccttctatcaggacctagaaaggatgtaaaacggccgggtataaatatcccctgggtctggggaaactgtcaggagcagtgacatcacaggaaaaaccaccaaccaaggccaaggagaccagagcccagcacctcacccagaggaccccagtcagaggccccatctcagacccgaggctagcatgggctgcaggctgctctgctgtgcggttctctgtctcctgggagcgggtgagttgggttcacatcagctgtccttgaattcgaaactttttccttgtgatttcagcaacaagcctcctcctgggctctgcctgaattttgtccctttccccccgcagtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagccaagacacagccttgcagagtcaccgctttcctgtgtagaaaccttaggggccctccaggaagctttgggggccaccaaagccttcgatgaacatttcctacaagagccccgacagaagattcagaacatcatagcacctttaatggcataaaatatctagcatatagtagaagcctagctattttgatttcctttgctgatctcagacaacctcttccaccacaccaatgtgcaaagacagatatggacacattctgccaagaaatcttaggttgaggactcagaagtcacagaaatggaaatatatatgcctgataattcatctgataaaattaactagaggatgtagcatacatatctcctcaggcatttaaaaatcaacattattgatctttaaagtatatgaagttaacaggacaccttttaaatgaacatatctgtgatttttgagcaacatatatctatatatgcaaccccacctctatgaagatgtatctgcatcacccagaaagtccctcactcccctctgcaatgcctctgtctgtcccagcaaccaatgatgtgacttctatcactggagagtcgttttgttggcaaatatttttaatgcaaatgtcaaacctcttctgaataatcctcttgaatacatagctaaatcatcaaggcagggaggagttcctggaggttttatggttttagaagtggttgaagccaggtgagctacctgacccatggtagggacaattctatctggagatggatattgtgccaaaataacctcaaaaggtcttttcggctggtagaagctgattctacaaaatttattcattttcattcgtttattttctcgtcaattcattcaatcaaacaattttatgttacgttttgacaaaagttaatcatctttaaggaaattattttgagttcccatcagacacacaagcagctgggctttgtgttcacacagtgagcatgctggggtcaagcaaaccatgatcacagtgacttcattgacagatgatgtcttattgggagaagggttctctttgacttgaccccatgtgtccaacccataaaacctgagccttaggctaaaatccatcttccttttctcaccctgccttgggcaccaggccactgtgctgtgtgtttctctgtctcctgaagcagagtcctgggcgcagatttggaacctattcgtgggcttgtttgatcccagctgtgactttcagtaccagggggtcctttgctgtgacttgaatttgtgttttctttactcttaagttccacagatgctgagtgacccagaccctggtcatgctcttgtgctgaaaggaaaccagcacatggggaggtgagcagtatatgaaacaaaatcatgtatttacaaccagtggcaagacttactggcaggtgctttgttcaaacactgttaggaatttgaagatcatggcagtagaatgtgaaaccaagtgcagggtccttccaaatgcaggcctctgtgcaccaaagatagacttttggagctcattttttttaaacaaaaacggaaacaacactctatgttcatggctgtaggccatgcgagaatatttttttaaattttaatttaatttttatttttccatatattattggggtacaggtggtatttggttatatgagtaagtttttagtgatgacttgcaagactttggtgaacccaccagctgagcagtatacactgcaccatatttgtagtctgttatccctcaccccctcctgctgtttccccaacacttccccaaagtccgttgtatcattcttatgcctttgtgacctcatagcttcgctcccaaatatcggtgagaacatgctatgtttggttttacatttctgagttacttcacttagaataatagtctcccatctcatccaggtagatcattccaaatgctgtttattcattcctttttatggctgtgtagtatttcatcatacatatatgatatatatatgatatatatgatatatatgtgatatatatgatatatatcatatatatgatatgtatatgatatatatcatatatatgatatatagatgatatatatatcatatatatgatatatagatgatatatagatgatatatatatcatatatatgacatatatatgatatatatatatcacagtttctttatccactcgttgattgatgggcatttgggttggttcctttttctttatcactaaattaatggcagcaataaatccagaacattcctcattaccctaaagtcagccctgtctcccaaactcccttacacatcaggacacctttgtgcccatagatcatgggcagtgcttggcagccaccactgtccacacagagagggtagtcagtagcgttaggtggttctgcttgctggggtctcaccccaggcacagaaagcaggagccctgggtggagctgaaagtgctcatctgggtttgtcaggagtcccatctgtcagtgaattcacaagaaacagaacaaaacaactccttcaatgttgatgagactgcccctgggatttggaaagctaataacagagaaaaccaatatagacaaaggattttaaacaggactatcggattatgatcaattaagcaaattagaaaaggatacttgaaggagtatttgggacacaggaatcaaaaacaccaggaagacatgaggagtttttccaagattgtagactatagcaatacttagataaccaataccagtgtattaatgagtaattattagtattattattttgagatggagtcgcactctgtcatcaaggctagaatgcagtggcatgatctcggcttactgcaacctccgcctccctggttcaagaattctggtgcctccgtctcccgagtagctgggactataggtgcacgtcaggatgcctggataatttctatatttttagtacaggtgggatttcaccatgttggtcaggctggtctccaactcctggcctgaagtgatctgctctcttcagcctcccaaagggctaggattacaggcatgggccactatgcacagccaagtaatttgtatcatcatgggaataaaaaatatacattgagttacaaactaattaccaaaagatatttaaaaaatggtagacttgcatcgattcagacaaaggcattcttcccatccaaactgttcactggtgcattgatcttgaatttgaccatctggggaaggggcgtggcctctcctgacagcaaggctctggggcccaggcagggagaatgaggtctcagaatgacgcccttgaaagacgtgttcccttttcaccaatgcacagacccagaggacccctccatcctgcagttcctgccatgagcctcgggctcctgtgctgtggggccttttctctcctgtgggcaggtgggtcctgggcggggccccttgtgtggatttcaaggcccatcccctttccactggagcagtagcatcagctttgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactccacagtgctgcacggctgtctcctctctgcacagaaaggcaagggaaggtgctgccctcctccgcagcacagattcagcgatgcccttggtcctagcaccgaaaactttggagccccaatgggcccgggcggtgcgagccttcatctgtgccaggtgcctctgcagtcggtctcggccaggcctggatcggtcccaggacctcagatgtcttccttgttgccctccggtctttcctctgaggtgtccttttgggctagtgccaggggtttcccagctctgactttcctagtcattcacctgagtctgaggcctcctaggtgaaataggatttgtatttcagatccatctagactcccgtctctacctgggtaccacgtgctttcctctctctatgatttttcctcatgttgaaccctacggtggtctcagctgcagcctgcatttcctatattcacagtcgccctccaaggccttgctgggtttctcctccccgacctccctgcccttctctactccagccatgttgagagactccaaagtccatttcctgtgccctgggctggagccttcctttctgtagtggtcaacacctacctgtgcttcagatctcagcatcatcagccctagtgataatcaccattatgcttcccttggctcccagctgaggtcagtttccctctcataatctctcatggtatcatgtgtctgttaatcagtagaatttagcacagttggaatcttccaagtactttaaaccccatgaaggccaaggctatgcctgggttataaatcagcagctgagcctggcacaaggggagatgcatttcagagaatggatgagtcagtgatggagtgagtgatgagtggatggatgaatccataacaggagcaccctagatccattttacccttgcggagatctggctgtaagtacaagaactcttacccttttgattgctgggctacgggaggtccttgaaattaatggggagtcgctatcatgggcggccccaccttggtcaaagattcctcctgagtctgcagcaccagacctcctccaggtctctgtgctctccttcagactctttcccacaacaactctacacagatcagagatccctttccagaaacccatgcatagagttgtgttattttggaaccacttctggtaccaaaaactccattaggtttacatcaataaaacagaatcactaaaagtactatggagaggaggatttatgacaggagttagaccttatataaatgtagggggagctgaggaagagaaggtctggaggggagatatagctaggcagatttaattcatgattaatgtgaccgtgacctcttattctactcaaaggagagcatatgatttcaacaaaaaaatattgattttcctttgtaaaagtttgatccaaatagtgagctatttttgtcccataattgtcttaagttggctaatggtggaacaaatccgactttgatttccttgaaagaacaggaaaaaaaccgtcattcatatacagtcttacaggctctattttatggaggaagcataataaataggaaagagaaaatcagaattctcttctggaacctacattgggactgtcctcagagcaggttgtgatgtgaggaatcaaatctacaggggtatttcgcagcttggagcgcagcagactgttcccgaccccatgcatttgggggtgagaccagagacagttgaaaaactatggaatcttgacattctgcactctcaagcctggcctctccctgaatttcacagattaacatcagaccaatttattccgactattaaaagtattagaacaaaaaccaaggaggaccagtgagcagaagcaataaaccattaaaatggacatcctaaagatttaaaattttgccatcataagatgtgaacgtttgaagagctgcatttaaatgaatacaagaagggactgaaacaagaatacacacaaaaaagagacggcccgaaaccatcaaaaaacattaaagaaataatcaaatagaatgtctagaaatcattacgattactccacaaaacaaaatggaagctaaacagcagattcaatgcttctaaagagattgttagcaatatcaaaggaggatctcaagaaatcacctagaatgcagcacagaaaattaaatgtaaaatataaaaaaagtgaaggaacaaggaaaaaatgaagtttctagaatattagaaagcatataatgttttattgaaacttttcttactttcttgtatataactgacgtttcagaaagagaaaataaggcaaatgatctgaggtgattgtgtatgtgatgctagctgagaatgttcctgagatgtttgaggaccgaaatcctcgttcaagaattcagatgaattgcaagacaagtaggcaggtccctgtgaaactgcagaccataaatgacaaagagaagattttaacagcagtcaaaagggaaagataaataacttccagtggaatagaatgaaagaaataatcaaagtcaagaaagaggattaaaaataaccattcaataagaattgtagtcctcatttattgaagattgagattgatttaaaaaaatctataggacaggaaagaaaatatggaaaaccaaaagaattctgtgagtttgccaccaaggtatgttttctgaattatagttaacatgggtgggaaatgatcccagaagaaaggcatgagggcagtttgtgggggaacccatgtgatgggacaatcccattgggcacgtgtgagtgtgggaatggaggaggctggggcatgaatgggtatggcagagggcaccctgacttgcaggaaagacaatgagctcactccttggtgcctggtgttgggggcactgttggtgcatcctacagtacgtacccagcagacagaggagcgtctctgggatgagaaggtgaacttggagatgcagtgaggcctctgggtccagacagcataggtcaaaaaaagagaacctgatcaaagatgactgaaaatagaaatagagcaaaaaatgatatatgtgcctgatgattcatttgatgaaattaactagagaacatagtgtacatgcctccacagacattttaaaatcagcattatttatctataaattatacaatataaacattacacatgttaaataaacaaatcagtgagctatatatatatatatatatatatatatatatatatatatagagagagagagagagagagagagagacatatatatatgggttataaggttatatatgtatatccttataaccactatccctatacaaatgtctctatcacccagaaagttctctcacaccccttggcaatgactgtttccatctctgacaaccaaatgatatgatttctatcactggagaatacatttttctcaaaaaatctattagtaacattttaaaacctgtatcgactaatccttttttaatacatacatttaagagtgcaaggtggtcctggaaagttttatggtttaaaagtaaagttctgtgagctacctgatccatgttagggacaatcctatctggagatagataagatgatgaaatagcctccaaattactctccagctggtggaagctcattctccaaaattatttattcatttttattgatttctttactcatttactcactcattcaaattatttattttataatgatattgtgacaacaattcatcattttaatgaaattattttgagttcccatctgacacatacttaactggccttcaggttcacacactgaatgcaatgggactaaacaaaccatggtaatagtgactttgttaagagatgatgtcacatgtggaaaagggttctatttgcttttaccccaagtatccaacccataaaacctgagctttgagctagaaaatctccctttttgttctggccctaccctgggcaccaggctcctgcaccatgtctccttctgggttctggcccagagaagttcttggcacagttgtagcacccactcatgggcttgctggatcccagctgtgagtgacagtagcaggcccccctttgctctgactttaatttctgtgtccttctcaaataagccctatagatgctgagtggcctggacccctgccatgtgcttgggctgaaagaaaaacagcacctggggaggtgagcgggagcaaagttgaaggaaatctagaattgacagtggaaggaggagatgaggaatatcaattatggcattaagtaccagtgatagtagcaggactgtatcttatttccttaaacctctgatacttgtacagatagcagctgaccacaaccttgaagacctatttggactcaatggaaataatgcatgagtggactgtatcagttgcctctattaccacctcatactctcttggttccacctttgattccagccacagctatgatgaacagttctatgcagacactgacctgctccacagttaccgcacctcaccttcaatgtggccacgtgttcccaaaacacgctgttgctgaggcatgagacacattggtggtctgcatggcgcttgttcatgcacaatgaagtgtgagtgagttaatgtcctatggggcaattctcaaccactggagaatgagaactggtggataaaagccttggcattagtctcaggctcctagaaaggcctagtttgatagccagccacctatctatagagatggcccgattaatatgttttcctttgtattttctctgctttttgtttctctgattcagtatggatattttcacctgacctatcttccagtttatctagtcttttcagctttatctatccttctttaaaatatatatatatatatttttttttcctaaattttatgtatttcatatatttcagttctggaatttccacttcaatcttgactacagtattcagttgtctgctaaaattctccattttgtcatttcctttttgattatattaacatcagttattttaaaggcagtgtctgataacacatctctgttggtgtctatttcttttgtccgctttcttttttttaatttttggtcatgcaatgttgttttctcacacaatcaacaattcatttgaatgctaggtattgcatataaaaattacagagataatgaggctctgaatgatttcatcttcctcagaaaggattcatgtttgcttctgctggaaattgtagcagagacaggtcaccttaattgagttgatgactgagctggatcagagctgggattcagccttcctgatggcttctcaactttgctattagccattaaacttccaactagatttctggagtattttaccagcttattaaagtgtaaattacataacataatatttgcctactggaagtgtgtaatttaatgagttttgataaatttgtggagttgtgcaacaatcaccatgatctagctctaaaatatttcatcctccctacccagaaagttccttcgtgctcattttcagtcaatctctgcttctacccccagcaccaaggcctggggtctttgccaggctcctctcctactcagtagtcactgaacgtaaatgttctccaggccagaaaggtggtggatgctcctcaaagcctttggcccatcagtcctccctttcttcttagcttctcagccatcaaatgaaattgacaaatgaatttaagggaaaagtaggtttttttttttttttagatttatccgttttctatgatatccctatcttttacgctcttactgccccagtagctccaagtgccttcaaacatttatgttttatattttgttaagcttttctagttgtttttggtggaagtgttgttctgccactatccagtctattaactctgaaagtcagtttttatatttattaaagatgaagtgcaattgagttggtaggtttgtatgtttgtattatggtggaaacttcctgaagagagtgaggagtgaagcccctctagtctcccgtcacgtgtccctaataagacctctaccaccctgctgcctttgttccactactggactgagccttgacacgtttgaccctttggccacaaggaggagctgtgactctgctgagattcagagaacttggaggaaggagagacaattctctggatggcagagggttaatagaaagattgagtttatttacaacaagggaaaatgtggtctgcaaagaatgctagtcaaggctctaagtgtgagggttaaatacagactattcattttgctttgatatgcaggcgcttttgtgctatggaagagcctggactgtcagacttccactggagcgtgcatgggattagaaaggacaaggcatgagctggggagagtgggagcccacaagcagacacagatggaggaccccttcccaagaggaataagagaggctctgggtgctgggccgttgctccagctcagcccagtacagctgagccctgccatgaagtgagtctggccggccaggggtcccttggggatcttgcagagaataataactcagggaaatcttcttatgagaccaaaggtgacctacagccctgttctcctcactctaaattatcggggaattaagctagaaagaagttttttcttgttcctcttctggatggtcctctgagtttttggagcaggagctccccacagtgataggaaacccctctcctaggcctgagcaaatgtttctatcaaaacagcatcaccagactcccttccagcttccatttccaagttctttccctatctacgaagaaccgtggaagctagacttgtccagacgtcaaaggatctgatgatgccaaaacacctggagataggaaagaaggtggcattgacagactgccaggatgcacacctgaaacgcactttgttttcactacaggctcgtgtttcacattttaaaaaagcatttggaacttccctgacttcttggaaatccaaaaatacaacaaagttacattttagtagactctagtcagtcatctggcaggaaaaagcttcaggatataaataaaagtataaatagtagtatatacatatatatactaattatttatatataaccttacatgtatatatactacatacatgtatgattatgtatacatatactatacataatatagtgtatacgatacatgtactatatacaatatatactatattatatatattctgtattacatatagtatatgtatatgcatgtattaccatatatgtatatatacatgtatgtatacgcatatattactatatatgtatatatacatgtatgtatatgcatacattaccatatatgtatatatacatgtatgtatatatgtaggctggatgactagagcctacatcaaatgtaactttgttgtattcttgaatttccaagaatcaagggaaatttgaaacgtatatatccaagtatgtagtgtgtgtgtatatatatatatacatacatgtatggtaatgtatatacatgtatataatatatactacatgtaatatacatgcatatattatatatacatgtatatatatacatgtgtatattatatatacatgtatatatatacatgtgtatattatatatactacgtgtaatatacatttatatatacatgtatttatatataccactaccaaatacatgtgtatatatatactaccatacatgtgtatatatatacactatttttatatataatatatactacgatacatgttctagcatattgcctgaagtaaaagtccagccaaatagtttaaaaggaaaaccatgagccttcctgtgaagattaattttgcatttcatcttgaaatggaacaaagaaatctactgaagatagtcaattcacttctatatacggaagtctacatttatcagctttctacagtatgagcgactttcaaatctcctaaaagttacacaaatcagaatatgcagaacacacatttctaagctcaatattaaatatgtaaagtgactaacttgaacgtaagagttggacgttcagggtcctcctgtgatttcttcattcccaccatcacaaaacatctacaccttcttctcagtaacaaaaatgagatgacataaaatcatttttcatagttaataaataatacctatgcatcatgacattgcattgattttttgttaatggttgttttcaaatgactataaattaaacatttataatctatacaatagaaataataaatgtaaatattttaagtggatacatgagattttagtagccaaacaggctcacacctgtaattccagcactttgggaggccaaagtgggaggatcacttgggcccaggagttcaagaccagcctgggcaatatagggagatcctgtctctgtattttaaaaaatagttatacagaaaagtaacatgaaatagtctgcaacaggatgtcctatctgggtttgatctgaatttccatttagaaaacagacaggcactggtccatctgcgggcataggttctcatgaattgatgtgcatgttgacttttgtattttgtcaaagttaaaggagatattttgatcagagtcagagccacaagtaactagcaggaaactgagtgggatggaggttatgccatggtccttgcttccttgcagagctaagaaaccagttgtgagcaccagcgaaaagagacaaagtcagatgaaactgaaatcttcatgggactctgtgcccaagaaaaccagcttgacaggattgggcacaagagctattccttccatcctacgctgccagagcacacagcacagtttcccccatgagctcttggggagctggaggagggagatagctgtgctgggcggagtcgtattcccatgggaagtccaaaaagtagaggcagggatggaggttttccttctagaaagagtggaagattttgtttacaaacgtacccatacacatgcctttctcccgaagacccaaactttggggaattgcttaaatataacaaggaggttaaatattggacagccaaaaataggaccgaagccaatctcttctgaagtaggtgtagtcactgtgcattagtcagatattcaaatgagcaaagattcaagaggaaaaaaaaaagcattattggaaaaggaagcaaaagatcaagagaagaaaaccagcctgactctgagaggagagcccaaaagggagaggaagggaggaggtcctcagatcccgggtagggagcagggagggaggggtacaggcacaggaatgactgtcagagacacatcctggaggccacaagtccactctctcaactattcccagaaattccaaaaactcctttaaagaagccagtgcagggcatgaaagggaggagccatgctagaggagatcctgggaatgggggaatgattacaggctgtgacctcaatggcacagcacctctcagaggcagtggaaaccacagcctagtcttctcaccactgcagaccagaatcctgccctgggccttgcctggtctgcctgactcggccatgggctgcaggctcctctgctatgtggccctctgcctcctgcaagcaggtgagtcctgggcccaagtgacaagatcctgttggagtccccgagccttttcaccatgacaacaacaggaggctacctcctgggatttgcctgaattctgcttctttcctttacagatccactggacacagccgtttcccagactccaaaatacctggtcacacagatgggaaaaaaggagtctcttaaatgagaacaaaatctgggccataatgctatgtattggtataaacaggactctaagaaatttctgaagacaatgtttatctacagtaacaaggagccaattttaaatgaaacagttccaaatcgcttctcacctgactctccagacaaagctcatttaaatcttcacatcaattccctggagcttggtgactctgctgtgtatttctgtgccagcagccaagacacagccttacagagccactgcatccctgtgcacaaacctcccggctcagccaggaagctgtgggccgtgtgtgcacctgcacccaaggctccagtctccattccctgatggcctctgatggagtttcagtctgtagtacagcctctgccagtgcacctgatgtggcaattctccattttatgtacacagaactctcagaattctgtttatcagctaaagcaggggttcacaacaaagtcagcaaagtatcagagctcaactaacaaaacaggagcctgtcccatgcactgaaggtctttactgatgggagaagccatttcttgtctttgtctgctgcacatatgggtccatattttactaatgttatgattataaacacactgtaggcaaaaatggttgatgagcctaagcataaagaagaggggaaggaaagtatttctaagatcaagagacaatttggattatcagtgagtattttgtttgacagagaaatattttgagaggcgtgaaattccatggcaataggtaaactggaaagtgttgaggagaagtcagtggaggcagccttgtgcattgtcggctccttctcttcaagaagggtgaccagcaagagtttctcccaattctgatgagtgtcatcttgaactctcctcaagagcaggtgacagctggatgacaggggatattgggagacatggaaaggaatttggacacaaatccctaggcagtggtgagccactggtcctactccaagtgaaacaacatgatgaaactgatattttggtacaggaacactggtagtagtatggatcagaaaagagatagatttttgggtggcatgaatgattaggagacttctaaataccctccatgaaagactagaaatcgtttatgtaaagcattgtggacgacataggcttgaggctctggattatgttatctcttggaaagagtgttgggttttattctgggacggttgaatgtaggacttgctaagttctatttcagctttgcccttcctcttagggagccccagcctgtggtcatcattgctagtgcatggccttcccagggtcttagtgggaatcacagtgtattcgccacatcactccactgcaactgggtctgaatgccctggctcttctgaaatctctgcccatgtcttcagccttccagaacttgttctctgctcagccttctggtctcccacccttctgcatacacaatttaggatctgactcaggaaaaaaaagggggttttcttacatataatttttgggttcctttttagtactctgtgtcctaaatcccacgtgtcttggagtcagttatgtcctatcttcagtcacatatactactgctatttggtacagacatgtttacttgactttacttcacgtttgccattccactcttcactcttctttcttgcaattcagacagtcctgaggtcattttccttcttcagatccatcccatattcagatgacttaaaatcacctgtcacccatgctgtgctttgagaaatgtttatgttagctactgacatcagggcagtcaagcctctcattgtcattgttattcaaggtaggttgaattccattaaaaaataaaaatccttgaaatttggtttacttattgggaaccacacaatgatatcaaattctttttaattcaattttttttcttttgtggtggaagggccaagaattgtttccttgctgaagcagactcctatcataataatttgaatactaacaacgttattttaatactaacaacgttaacctttaaatcagattgatgttaggttcttatctaagaatgaaatatatccaaccgtagcaggttgaaggtctctcatatatgtaacctgttcaggacgagataattcaaccactttccttaaactctgatctaaatgcctttacattctttgttttaagggccacataaaaatactctgaaacaatttacacatcagaaaaatgctaatactttcctcctggcccagcacatctccaagttaaaaaaatctctaaattctcaacccatagtttaatcatggtaactcccttctacccccaacatagatttttatgtaactgatttgtaactacaaccctaaccctacaatcacaattgtcattacaaaatactaacaaacatgtgctattaccaatagatggttaaaatcacttagggattatgaatcatgtcattcttgtatttatttgtacttattctttgtgtttatttattatgtcagcttcaagctgatttccctttcccttgctccccacaccttttgttgttccttttcagcatcctgtgtatgttagctctaagcccagccaagccccatgccctccacttcagggacagagggtggctcatccctttcgtgctccctcagctccctccccagtgcctggtggctggttggcatcacagccatgcccttgaataatgggcgctggtccacactgcttctgtggtcatgcagtcatcctccctccacagagctgggccaaaaagggctccactgcccttaggcattgagggaatggacattctgagtggcactgtcttgtgtgatcccacaggacagaaggagattccatcaatgggagtagtctgttgctgagagggatcctgaaagatagggggacagagacacactgggaggatccacataaagaggaagcagctgagaacaaaggagcccctgccagaggaatatccttggggagtaaaaagctgactctgccctttctccccagcccattcatcccagcccagacaattcaaatctaccttctatcaggacctagaaaggatgtaaaacggctgggtataaatatcccctgggtctggggaaactgtcaggagcagtgacatcacaggaaaaaccaccaaccaaggccaaggagaccagagcccagcacctcacccagaggaccccagtcagaggccccatctcagacccgaggctagcatgggctgcaggctgctctgctgtgcggttctctgtctcctgggagcgggtgagttgggttcacatcagctgtccttgaattccaagctttttccttgtgatttcagcaacaagcctcctcctgggctctgcctgaattttgtccctttccccccacagtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagccaagacacagccttgcagagtcaccgctttcctgtgcagaaaccttaggggccctccaggaagctgtgggggccaccaaagccttcggtgaacatttcctgcaagagccccgacagaagattcagaacatcatagcacctgctcattcatccatgtggcaacgttacatcctatgctcatatttagagtgtgggttttctttagcgtgtgactctgccctgttaactgatttgaaaaatgataaacacattcagatctagtctttttaaaatccctttttaaattgtaaaataaagcaagcatgctataaggggattgtttggtttaagatgttataagaccctctcaacaaccacctgcgtcactacagagtcataccctgcactggaccacagagtgtcctgtgaggagccaagttcttctgacactttatgcctggtggtctccatgcctctctttctcagtaaccaggggtccattctgtcataggttgctgacacccaaggtcaagcagcactgggtttgggggaatcatagaggcaacttccaggcaagggtcccagggcgggagccagctggagagaacagtagacaactgagcttttggggaatgggtttgagaaatatctgtcaacccaattctattattctatcttccatcttgtctcttctctattgttcttatttaaactccaagctagagcgtaaattccagccctgatcaaagctccatatccctcacagacaccttctctgaaccccgcaggcagcaaatgtgcctctgtccactcccatttgtgtgggcggtaagccacccaagtcctgaggcaagagaccgagggcacgagctgttccagtataataaagaaaatatataaaataagaatagttatactagtaatagattatagatatgatggtatacaaatattatgaataatcagtttgtagcattactcttcattccaatattataataatccttgctctacaattataacctaggaaaaaccaggccatacagagataggagctgaaggggcacggtgagaagtgatcagaagacaagagtgtgagccctctgtcatgcccagacagggcccctagagggctccttggccttgtggtaaccccagagcctgggaggaagccccttgcctagaggaccttggtctagccttagcgtcagtgcctagaaaaagcacccattacttagccgaccaggaaagggagtctccctttccccgggggagttagagaagatattgcgtgtggctaggcttggtgctcacgcctgtaatcccaacactttggaaggctgaggtgggtggatcacgaggtcaggaggtcaagacgagtctggccaacatagtgaaaccctatctctactaaaaatacaaacaattagcgggttgtggtggtgtgtgcctgtaatcccagctacttgggaggctgaggcaggagaatcacgtgaacccgggaggcagaggttgctgtgagctgagatcttgtcattgcactccagtctgggtgacagcgtgagactccacctcaggaaaaaaaaaaaaaaaaacgataccgtatgtgtgaatgtgtgtgtgcctatgtgtgtgagtgcgtgcatgtgtgtgcatggatgtgtgtgtgcatgtgcatgtgtgtggatggtgtggatgtgtgtgtgtgtgtgtacgtgtacatgtgtgtgtgttcttgtggaaactcacccacatggacccaggttctctgggtggcattactgagaggtgctgggtcactggtagagctcataggcagttctggggagtgacaggaaatgtcacagccaattgaatctgcctaagttacagctgatagggttgtttatttcaagattttgtaagttcagaaatagatttataaaaaatccaagaattttctttctaaaatgcactacctaaaacttgctgataattcatttaaatacaaaatatgagaacatgggtctgattaatcaaaaggaacgattgaatacagtttccaggatagggctgtttgatatcttcacactgtttaaatctgtggcctgtatttttcaggctcctctcgtccatcctagcatactaattgcaatgctgtaacattgtttattttgcaatcaaaatgttggttaatgcttgcttttgctagctaaaggtgaactttcagatcaaccctatattggcccttctgggcaagtatacagagggtgtgtgtgagagggtggggattgcaggagtgagggcagggcatctctcttccttctctggacaatcttgagttcatcaggccaggtgtgaatccgtgagactgtggatctttggccacttggaggcgctgtagctccacgatgctgtaagaaaccctgggcagggctggagagtggccaggagaagagggttgaaggggatgcctggctgcctgctgccatcaggggccctttgggattccctgagtgggcctggacatgtggaattaagcacagacccctcactgccaaagaagggtagggatgctagagtcctcagtttgtaccaaggagggagggtgtctgcctctgcgtgggcagtggagggtgaaggggctggggtggcaagggctgggaataagtgtcaggcctgggacagggaggacacaggaaaggcaggtgtgatggggcatgtgggggctgtgctccacccgctccacctttagtttcagggctgtgtaagacaggaagatctcatggagtagcaaagcctgggccctgccaatggttgcagagtgcaggggtggccggcagagggagtaactgggaaaggccagttccccaaggaaatgccagaaactttcctgccccattcagaaagtgactgtgaggcgggtgcttccagccagaggggctcaggccctgctgagctgacagcgttttctttcccagacattctctgctgcttctatatgtgatctgttttaatgctcactgaaatcacaagtatttattattttgactgtttttgtatctgagggaaggcagctgtccctggtctcatatttaataactggctgtcgtgtgctctccaacacctctccaccctccctactcagtacatctgtcccgtcatctggcttcctctctccaggtcccattagcaggaggggaaggtcatgcctcctatgtgaccattagaacctcttccttgacaagtccaagaaacacgtgacttccgggccaagcatatccattcattcttcattgcagccaaaagaaagatgaaattttctaccctgtagactttctgtcactaatgcaatgtaccttgaggaaaagtaacatgaataactgttattcattagttaatttcttttatatcctttattcaataaagtctttgagaccctttctttgtatattttatgacataaaataaaaaatgggaaaaattgtttaataacaaatatttcttactttttagagtattaaggcttaaatttattttgttttattttagttttatattcaaagtactttactcagtttctgaattacaaaaatttccctttctttctctgtctctctttagctacctccctcattttttttgccagcattttaatttaatgtggtaggaacatgtaacatgagatctgtattttaaatagatttttaagtgtacaatacagtattgtaatctacaggtacaaggttgtacagaagctctctagctcttacttatcttgctgaactgaaattttatacctgctgacagcaactccccattttctccattcccagcccatggatatcaccatttttatctttgctttcatgagtttggcttttaggtagcctgctataagcagaatcagggagtatttgtctttctgtgccaggcttagtcacttatcacagtgtcctgcagctttatccatgttgtcacgagtgacggggttttcttctttttaatgcttaataatataccattgtatgaatataccacatttatggactttgactgtttctatgaaactgtctgtcacataagtgggagagtcatttgcagaactgaaagcttggattacatgaatgggcattcacatttcaattctactccatgggcaagacggagaataaaataatgattccatcatttactcttactttgctatacacaaaatagaagtcctgcttttgggaagtttcagttatttagaaattcgactgtcagaagaaaaccctaagacacaaatgcttttctcattgtacacgtgagagaattggctcattggttaaataacctgaccaaattaaatagctattaggatgcagtactgatcctccaaccctgcccagtctaagttccatgtttatagctctatgctataaaatatttcataaagctgccaacctagaaaacattggaaagttttcccctacatcccctttaggcctgctggctctaatagcatcatagtcagagatcagtttaccctggagatggtggagtagggaaagaagtctgaagaggcaccatgactccccgccctgactcccactctaacaccagctcatcaagacctgaggccagttcttaacgggttaacttaagtttttcagtttttttttacctataaaatgagactactactgtccatcagcagagttctagataacctttaatggcataaaatatctagcatatagtagaagcctagctattttgatttcctttgctgatctcagacaacctcgtccaccacaccaatgtgcaaagacagatatggacacattctgccaagaaatcttaggttgagggctcagaagtcacagaaatggaaatatatatgcctgataattcatctgataaaattaactagaggatgtagcatacatatctcctcaggcatttaaaaatcaacattattgatctataaagtatatgaagttaacaggacaccttttaaatgaacatatctgtgatttttgagcaacatatatctatatatgcaaccccacctctatgaagatgtatctgcatcacccagaaagtccctcactcccctctgcaatgcctctgtctgtcccagcaaccaatgatgtgacttctatcactggagagtcgttttgttggcaaatatttttaatgcaaatgtcaaacctcttctgaatagtcctgttgaatacatagctaaatcatcaaggcagggaggagttcctgggaggttttatggttttagaagtggttgaagctaggtgagctacctgacccatggtagggacaattctatctggagatggatgttgtgccgaaataacctcaaaaggtcttttcggctggtagaagctgattctacaaaatttattcattttcattcgtttattttctcgtcaattcattcaatcaaacaattttatgttacgttttgacaaaagttaatcatctttaaggaaattattttgagttcccatcagacacacatgcagctgggctttgtgttcacacagtgagcatgctggggtcaagcaaaccatgatcacagtgacttcattgacagatgatgtcttattgggagaagggttctctttgacttgaccccatgtgtccaacccataaaacctgagccttaggctaaaatccatcttccttttcttaccctgccttgggcaccaggccactgtgctgtgtgtttctctgtctcctgaagcagagtcctgggcgcagatttggaacctattcgtgggcttgtttgatcccagctgtgactttcagtaccagggggtcctttgctgtgacttgaatttgtgttttctttactcttaagttccacagatgctgagtgacccagaccctggtcatgctcttgtgctgaaaggaaaccagcacacggggaggtgagcagtatatgaaacaaaatcatgtatttacaaccagtggcaagacttactggcaggtgctttgttcaaacactgttaggaatttgaagatcatggcagtagaatgtgaaaccaagtgcagggtccttccaaatgcaggcctctgtgcaccaaagatagacttttggagctcattttttttaaacaaaaacggaaacaacactctatgttcatggctgtaggccatgcgagaatatttttttaaattttaatttaatttttatttttccatatattattggggtacaggtggtatttggttatatgagtaagtttttagtgatgacttgcaagactttggtgaacccaccatctgagcagtatacactgcaccatatttgtagtcttttatccctcaccccctcctgctgtttccccaacacttccccaaagtccgttgtatcattcttatgcctttgtgacctcatagcttcgctcccaaatatcggtgagaacatgctatgtttggttttacatttctgagttacttcacttagaataatagtctcccatctcatccaggtagatcattccaaatgctgtttattcattcctttttatggctgtgtagtatttcatcatacatatatgatatatatatatgatatatatatgatatatatatcatatatatcatatatatatgatatatatatatatcacagtttctttatccactcgttgattgatgggcatttgggttggttcctttttctttatcactaaattaatggcagcaataaatccagaacattccttattaccctaaagtcagccctgtctcccaaactcccttacacatcaggacacctttgtgcccatagatcatgggcagtgcttggcagccaccactgtgcacacagagagggtagtcagtagcgttaggtggttctgcctgctggggtctcaccccaggaacagaaagcaggagccctgggtggagctgaaagtgctcatctgggtttgtcaggagtcccatctgtcagtgaattcacaagaaacagaacaaaacaactcttccaatgttgatgagcctgcccctgggatttggaaagctaataacagagaaaaccaatatagacaaaagattttaaacaggactatcggattatggtcatttaagcaaattagaaaaggatacttgaaggagtatttgggacacaggaatcaaaaacaccaggaagacatgaggagtttttccaagattgtagactatagcaatacttagataaccaataccagtgtattaatgagtaattattagtattattattttgagatggagtcgcactctatcatccaggctggaatgcagtggcatgatctcggcttactgcaacctccgcctccctggttcaagaattctggtgcctccgcctcccgagtagctgggactataggtgcacgtcaggatgcctggataatttctatatttttagtacagatgggatttcaccatgttggtcaggctggtctccaactcctggcctgaagtgatctgctctcttcagcctcccaaagggctaggattacaggcatgggccactatgcacagccaagtaatttgtatcatcatgggaataaaaaatatacattgagttacaaactaattaccaaaagatatttaaaaaatggtagacttgcatcgattcagacaaaggcattcttcccatccaaactgttcactggtgcattgatcttgaatttgaccatctggggaaggggcgtggcctctcctgacagcaaggctctggggcccaggcagggagaatgaggtctcagaatgacgcccttgaaagacgtgttcccttttcaccaatgcacagacccagaggacccctccatcctgcagttcctgccatgagcctcgggctcctgtgctgtggggtcttttctctcctgtgggcaggtgggtcctgggcggggccccttgtgtggatttcaaggcccatcccctttccactggagctgtagcatcagctttgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactccacagtgctgcacggctgtctcctctctgcacagaaaggcaagggaaggtgctgccctcctccgcagcacagattcagcgatgcccttggtcctagcaccgaaaactttggagccccaatgggcccgggcggtgcgagccttcatctgtgccaggtgcctctgcagtcggtctcggccaggcctggatcggtcccaggacctcagatgtcttccttgttgccctccggtctttcctctgaggtgtccttttgggctagtgccaggggtttcccagctctgactttcctagtcattcacctgagtctgaggcctcctaggtgaaataggatttgtatttcagatccatctagactcccgtctctacctgggtaccacgtgctttcctctctctatgatttttcctcatgttgaaccctacggtggtctcagctgcagcctgcatttcctatattcacagtcgccctccaaggccttgctgggtttctcctccccgacctccctgcccttctctactccagccatgttgagagactccaaagtccatttcctgtgccctgggctggagccttcctttctgtagtggtcaacacctacctgtgcttcagatctcagcatcatcagccctagtgataatcaccattatgcttcccttggctcccagctgaggtcagtttccctctcataatctctcatggtatcatgtgtctgttaatcagtagaatttagcacagttggaatcttccaagtactttaaaccccatgaaggccaaggctatgcctgggttataaatcagcagctgagcctggcacaaggggagatgcatttcagagaatggatgagtcagtgatggagtgagtgatgagtggatggatgaatccataacaggagcaccctagatccattttacccttgcggagatctggctgtaagtacaagaactcttacccttttgattgctgggctacgggaggtccttgaaattaatggggagtcgctatcatgggcggccccaccttggtcaaagattcctcctgagtctgcagcaccagacctcctccaggtctctgtgctctccttcagactctttcccacaacaactctacacagatcagagatccctttccagaaacccatgcatagagttgtgttattttggaaccacttctggtaccaaaaactccattaggtttacatcaataaaacagaatcactaaaagtactatggagaggaggatttatgacaggagttagaccttatataaatgtagggggagctgaggaagagaaggtctggaggggagatatagctaggcagatttaattcatgattaatgtgaccgtgacctcttattctactcaaaggagagcatatgatttcaacaaaaaaatattgattttcctttgtaaaagtttgatccaaatagtgagctatttttgtcccataattgtcttaagttggctaatggtggaacaaatccgactttgatttccttgaaagaacaggaaaaaaaccgtcattcatatacagtcttacaggctctattttatggaggaagcataataaataggaaagagaaaatcagaattctcttctggaacctacattgggactgtcctcagagcaggttgtgatgtgaggaatcaaatctacaggggtatttcgcagcttggagcgcagcagactgttcccgaccccatgcatttgggggtgagaccagagacagttgaaaaactatggaatcttgacattctgcactctcaagcctggcctctccctgaatttcacagattaacatcagaccaatttattccgactattaaaagtattagaacaaaaaccaaggaggaccagtgagcagaagcaataaaccattaaaatggacatcctaaagatttaaaattttgccatcataagatgtgaacgtttgaagagctgcatttaaatgaatacaagaagggactgaaacaagaatacacacaaaaaagagacggcccgaaaccatcaaaaaacattaaagaaataatcaaatagaatgtctagaaatcattacgattactccacaaaacaaaatggaagctaaacagcagattcaatgcttctaaagagattgttagcaatatcaaaggaggatctcaagaaatcacctagaatgcagcacagaaaattaaatgtaaaatataaaaaaagtgaaggaacaaggaaaaaatgaagtttctagaatattagaaagcatataatgttttattgaaacttttcttactttcttgtatataactgacgtttcagaaagagaaaataaggcaaatgatctgaggtgattgtgtatgtgatgctagctgagaatgttcctgagatgtttgaggaccgaaatcctcgttcaagaattcagatgaattgcaagacaagtaggcaggtccctgtgaaactgcagaccacaaatgacaaagaaaagattttaacagcagtcaaaagggaaagataaatatcctccaggggaatagaaagaaagaaataatcaaagtcaagaaagaggattaaaaataactgttaaatcagaattgagattgataaaaaatacctacaggacaggacaagaaaatatggaaaaccaaaataattctgtgagtttgccaccaaagtatcttttcagagttatagttaacaagggtgggaaatgatcccagaagaaatgtatgagggcagtttgtgagggaacccatgtgatgggacaatcccgttgggcacatgtgagtgggggaatggaggaggctggggcatgaatggggatggcagaggggaccctgacttggaggaaagacaatgagctcatcccatggtgcctggtgttgggggcactgttggcacatcctacagaacgtgctcagcagacagaggagcggctgtgggatgagaaggtgaactcggagatgcagcgtgaggcctccaagtccagacagcatgggagcccaaagcgatgtcccatgcaataacgttgtttacaaggagcttataaatatttaaagtagtcacccaagtgtggtctaatataaatcctgtgttcctgaggtcatgcagattgagagaggaagtgatgtcactgtgggaacttccgtgtaaggacggggcgtccctcctcctctgctcctgctcacagtgatcctgatctggtaaagctcccatcctgccctgaccctgccatgggcaccaggctcctcttctgggtggccttctgtctcctgggggcaggtgagtcctcagacaccaaccattctcattgtgtgtgtgtgtgtgtgtgtgtgtgtgtgtgtgtgtgtgtgtgtgtaggggtgggctgtgtgcattcgtgtgatgactaaaattattttcctcattctgttcccaactttgtctccacagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcttagccacagcatggcacagtcgcctccttcctgctcataaacctcatccttctctctccttgcagctcctagacacccttaacagaggcttctctttgcttctccctccccatgggaaacaagtagatttggacctcagcttgtcctttgggtagaaagagaccacagatttacccttaagacacagtaactgtaaatgtgggtggtggaagcaatcgtggcccaccgggctattggagtcctcagagccagctcattgctctaaggcaagcactgggtgtcttagccttggccttcagggctgggacacacagtcttctttggggcctgggaggttgctgcccacatagagaagcttcgggcatggctgaggaacaggtgtcttcccctacatgtgttggggcatctgcaaggtctgaagcttcatccacaagaacattctttcttctgaagcctcttctgttacattggaagttttctgcaatacaagagcaaaccattcttcctgtttgatttaaaagtctttgtggcttttgtggccattacttggtgaatacagccaagataacaataagacttcgtttcttctgcctagtgtaagcaatgcgagttctttattttgttttcatttaccactgctcctgtcctgagagactgaagcatgcgtccactactgctccagtatcaacttggttccctaggaaatcgggtttctagaacctgaatgctgacaaataagagttgtgtacatgtataccatgcaacctgcgtttaaaaatgtatgtacatggtgaagtgactaaatctagctaattaacatatgcagtacctcaatccttatcctttcctgtggtgagaatacttgaaatgtactctgttagcaatattccagaatacaatccactgttactaactttagtcactgtgttgtacaatagatcttttgaacttcttcctcctatttgagtgaaattttgtatcctttaaccaacatctccccagcaccccatctccatcccaacctctggtaattgctgctctagtcttttgatttgaaataatttccctgaggtctttaacttgagaagatggagttttaaaaacaataatgcttatattacttttgttttgtttgttattttacatattgcaatatagtgtttgttgcaaatataaatgagtatactgtaataaaaattcttcacctctctttgagtgaagctacatttcacatatatgaaatttcaagctgtggtcagagctgacatgattatggatcatgggtttctgggagtcctcagagacagccctatacacaaaggttaagatagattatcccagacccagccaggacagaggtgccctgagtcctgcagagctggttggggaattatagttccctaaattcacttatcagaaattgtggtagctcagataccaaatttctttctctagcaaatgatgatcgttggcagggattgttctgaatccattctaattgttctatcaacagatcattccttttttagttgccctgtgtgtcctgggagtgaataagtcccaggcacagatgggaatttcctgaccttaggatgctgttccaaggacttccttgctagaccctgtctccagcttttcccacctttatcctcatgacccctaagacaaatggtcctaataatggaccagctctgaaacttaagattgaacagaacacaaaccacaactgtaaacactgatgctgaaagaagtggtaaaaaaaggtgagcagggtttcccacctgcactgagagttaacatacaaggacagcaaagggaaggttttattaataagcaaacaagaagcaataaaggccctgctccattgaatgtaactaatctctttgagttaaaaaaggagcacgtcaataaaagtatttcaaatcaaagtctagaagtttccaaaccagccagcacaaccctgagagctctgtgctctcagcaacttcagagaactcatcaatcctttctgggctcaaacttccctttgtccactcgaagacccagggtcacactctcatcctattacaaaaacaatgggctttgctatcgttgctgatgcctcatttctaggagttgagtattaagcactgaagagctttgaaagttgggcttctgagtcaattgatgtgctggagccaacttttctgactcacgagagacaaataggcacactcttcccagctccccattcagtgaagccatgttgacagcttgaaatccaccatagtgcctgtgttgatacaacagaaattggtaagtactactaggcatgtgcccacctccacagacactcagtgtaccagcacatcactggaatgttttctgagacagtgatgtccctgttatgtcgtcatgtcttgtggggccaaaaggactccgaattcacctcctctctgttcttgcttttagaaaccataatctaaaataacctcacctgacactatttctattcaatctccaaattccctcactttgtgggtctgtgtctcctgtaagcatgtcagtccacaacttgacaactattttgaatgtagctaaaggatacagtgaaccagtttattattttcaaattatccttccttgcatggaatatgtagatgctgcagtcattgggaacagagatggggcaagcagcagctctgggccgtgaaccactttagagtcagacaattcttcagtggcacagacacacccttgggcatggactaatttgctttggaaactaagcagttccacaccagtcaccaatgaccttggatctatttccagctgagaggtcaaaaagatcacactacctaaatgtcctcctctccaatatatagtacagcccccatccatctcagtccctggaggtcatccagagctcccagagaatctctgctctggggcagaatcaccacgtctcctcctcgccagctccccacaggctccagcaaggctttcctgccaggtgcagggcatgggtgtggctctgctgtctctcaggtagagggaggccatacgatgatgtttgtataagaaggattgggtttcagaggttcctctcaaatacttgacataattttatttgctttttgtttcactctacaatgtcaccatttaggagagcaattattttggttgcattatttatggaactttgaaagatttttgtggttaaattaatttaagaaatcattcccattgtgcatcttttctgttcagatataatctgaggcagtgaaagaaacagcaatgattctgaaagcagtcacttacatgccctctgataaaggcattgttcaaggttcattactcacacctaactttcagtctactggaaatgaaaggcacagagttgggggcctgtgatcaagccacaagagaggactataccagctactctgggacttcagggcacgaagagatgacctcccctttagactctgctcaacgacgaaggaatgagttggtccatgggaacctgaggagcagaaattccgggagcctttaactgggacggagcaaggactgtagagcaagtcattggaaagggaaatggttcatctggtctgtcacagaagatagtggatagaaaggtcatataatccccagttccctggctgatttgcttccttatgatactattttgcagcagcgtaccgtcatctcacaccactcctctacctcttccagaatcatctcctccctctctgctgctcagatcagcacatgtgcattgcacaagctattcttttactgtagcagaccttttgctggtcttaattatatccatccttattttcccattagatactgctccctccatgattgcttattgccttgcaagggatcctttaccccgcgcccccagacagagtctcactctgtcgcccaggctggagtgcagtggcgcaatctcggctcactacaagctctgccttccgggttcacgccattctcctgcctcagcctcccgagtagcgagtagctgggactacaggcgcccgccaccacgcccggatgattttctgtattttttagtatagagacggggtttcaccgtgttagccaggatggtctctatctcctgacctcgtgatccgcccgccttggcctcccaaagtgctgggattgcaggcagaagccactacgcctgaccaagggatcctattttttatatcccagttttactttttattaacacatatctgaccccatcttgaaggtaatcacattatctgcctagacttttgctaatctttatttttatggtaccattgtcatttggggggacatatttgtttatctttggtaatggaaatgaaattacgttacacttcactttctgtgttttcttcctactttagggtaaatattatttccttctattcttcctattctattcctctctctttagatagttttaagggagaaaatgtcagtgagactgtaactgcagctatggggtaagaattatttagaatgagggtgggatattaagcttgataactcaaaggaacagtcagggttaaaactaatgttgggatcggggttcagagaagttgcttgtaaaacctgcaggatggcacttctggaatagtctcccggctccctctgcagacacttcccagcatcccttgggccatttcccttgcaaaagcaatgatgaaatttcacttattggccacaagatggcactgtggtccactgggctctaagagactctggggagagcctgggagagcagcctaggaaggaaagggttaagaaaaatcagggctggcatccaatatcatgcagatgttgcagcagttttcagttattgctagactacctacagttatacaacatacaggaaatacctctaatctttaatgagatccacagttgaagaagtttggcctggcagccttggtgtcaagggcaggtgcagacagaggagcaactatctcagaggaaaatgggaaagtgaggggtgggctgtggcttaagcccagtgcgtctctgctgcaccccgtcttccctgcagctcttaccaggcaacagcctccatgagagtaggtggatcctgcctgagcccagtcagaatgccccggactaggtgaactctgtaggcatggggagtaacacaacaggcccacctttcacacgttttttttttttttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcacacgtttccaaagtctgggctccaagcctttttttcccctttcctctgcagagtcctgccacttctgaagccttgtcctcactttctgcctgcctctcccacagcccccatggaggcagggatcagccagataccaagatatcacagacacacagggaaaaagatcatcctgaaatatgctcagattaggaaccattattcagtgttctgttatcaataagaccaagaataggggctgaggctgatccattattcaggtagtattggcagcatgaccaaaggcggtgccaaggaagggtacaatgtctctggaaacaagctcaagcattttccctcaaccctggagtctactagcaccagccagacctctgtacctctgtggcagtgcatccgcagccctgcacagccaactgctctctgcacaaaaaagggcagccacaggctggaggtgggcactccttcccaaggcctctatctcaaccaggagataaagatgccttttttgaagctcttctcagatgtcccagcaatgggctcccagtctgtgcatcctcctgcagcaggaacttcagtgtgagctgaggtccatcactgtgatgtggatgcacgaatgcaaacaacacttaatgttattttactcaattcagaatattctggcagttgcgtaaaataggaatagtagctcccaaaatgaaatttgtgtctcattttctttatgagagaaaagaaaaaaaaacagaaagcagctgggcagctttaacctgcttgagtgatctgggattctacaagtctacaagtggtacaaagaacatcaccttggcctggattccaatggataccaaacactacaaaaagtattgaaaacaatttataaaagacctaagtaaacaatctacttataggaaatgttagtagatccatcgcatagtgccattatacctgacgatgatcaactagtgaaattattatgtagagattatcagctaagcctctacttattacctctgagcatagagcagtgtttgagccttctgagggtatcttaaggaaggaacttaattcttaccattactttggcttggattaaaatccatgagcttgtcgtttttattgtaaaatattacagaataataatgatcaaacgttttattttcctctagcgtttattcctctttagaacgtgcaggttgaagctcacacacatgagcagggttccttaagatgagatccattaactccaggactgggaggtacacagctggccttcacaggaagtgcaaaccccaaatgcagtgacccctcctgtgtctacgctgtgcccaatacccctctgtgaggctgccataaaggcgggcaggctccttgcttggcaaaaaaatcagttcaccaattggccactttgctgaagaccagaataaaaggctaaattgtgagaatgatgaatgcccaattcccaaattgtgaaatgtgtaacagttcacgattcttggaataatttcaaccatgtgtggtttgttttttttttaagtttttctttgtcgacagctttctttcggccactgatcctcagttgtttcccagccgccttgtcagctgatctcattttgatgctaatttttttttttttttgctagctttgggattatttgttcttgttttactatgtcctctaagtgtggtggtaggttgctaatgtgagatctctctaacttgtttatgtgggtgtttcgttctgtaaacaatactcctaacactgctatagctgtgtcccagagattctagtatatttaatcttggttttcattagtgccaaagaatgtcttgttttctaccttcattttatggcttacccaagtcattcactagcagattgtttaatttccatgtaattgtatgattttgagagatcttataactcttgatttctattttttttgtgctgtggtccaagagtatggttgacatgatttcagttttttttataatttgtttacaattagtctgtgtccaatcatgtggttgatttcagagtatgtgccatgtgtagatgagaagaatgtgtattatgctgttattgggtggagtgttctgtagatgtctgttaggaccacttagtcaaatgttgagtttagtttatgaatatctttgttagttttctgccttgacaatctaatactgagtgttgaactcttccagtattgttgtgtggttttctacgtgtctgtaggtctctaagaacttgttttatgaatccagctgaaccagtgttgggtacctatatatttaggatagtgaggtcttcttgttgaattgggccctttatcattatgcaatgcccttctttgtcatttctgataattgttggtttaaagtttgtattgcctgaaattagaatagcaacttctgctcttttttgtttcccattggcttggtcatttttctccatcgctttatgttgagcctatgggagttgcatatgagatgggtctcccgaagacagcatacagttcagtgtttcacttgtctatacaactggacgctctttttttttttttttttttttttttttgagatggagtctcgctctgtcgcccaggctggagtgcagtggcgcgatcttggctcactgcaagctccgcctcctgggttcacgccattctccggcttcagcctcccgagtagctgggactacaagtgcccgccaccacgcccagctaattttttgtattttagtagagacggggtttcaccgtgttagcccggatggtcttgatctcctgacctggtgatccgcccgccttggcctcccacagtgctgggattacaggcgtgagccacggcgcccggcagctcttttaataataaacgacttttatgtgctgtgtttagcctgtttacattcaaggttaatattaatacgtgtagatatgatcctgccattgtgttcttgcttggttgttatgcagacttgattgtgtagttgctttataatgtcaatggtctatgtacttgagtgtgttttttggtggctgttagtgatctttcatttctatgtttaggactcccttcaggacctcttgtaaggcaggtctggtagtaacaaattccttgaacatttgcttgtctgaagggatcttatttctcctttccttatgaagcttagtttggctggatatgaaatatatagggatactggttggaatttcatgtctttaagaatgttgaatattggctcccaattgtttctgccttgtaaagtttctcctgaaaaacctgctgttagtctgatgggattccctttgtaggtgacctgccttttctttctagctgactttaatattttttctttcatgttgaccttggagaatctgatgactatgtgtcttgggggtggttgtcttttatggtatctcataagaattctccgtgtttcctgaatttgaatattaaactctctagcaaggttagggaattttttgtgctcaatatcctccaatatgttttcaatgttgcttactctctctccctctctttcagggacatcaatgagtcataggtttggtctttttacataatcccatatttctcagaggtttacttcattcatttttcttttttttccattctttttttgtctgactgaattgattcaaaaataagtgttcaagctctgagattattttctcattgattatgctgttaatacttctgattacattatgacattgttgaggttagtttttcagctctatcagatcaattttgttctttcataaaatagctatttcatttttcagctaatgtgtcattttattggattcatcagattccttagattgactttcagctttcttccgaatcttgatagtgtttgtttctaacctgtttctgaattctatgtctatcatttcagccgcttcagcctggttaagaatcattgttgggaagctagtgtgttcatttggtgctaagaaggcactctgactttttaagttgccagagttctttcactggttctttctcatctctgtggtctgaggtttctttaatcttttaagctgatgtcttttggaagggttttttgcttttatattctatgcccttgagggtttcactgttacataagctgggttcaggagactggcttcatttatggaatatttcagggggctaagattcagctcagtatgtctgggctgcgtgttgtaggcctgtggtgctggaattaagcccagagctttggtttttgaccccttaaggttaaagcacctgctacaccagaggggctgaggcgttcccaattccactggcaacaacactgcaatggggaatgccagccaaagtactttttccaaatggtggcattggggtacatgctcagaagcatgtgccaataatggcaatgtggcagtttccatacatatgtttgtgctagcttttttattattatatagtaaacttctttgcctctttttatagttattgtcttgaaatatattttatctgatatagatatagctactcctgatcttttctggttttcacgtgcatgaaacatctttttgttatctcttcactttcaatctatatgtctttttaggggaggtgtgtttcttgtaagtgacagatcattgggtcttatttttatattcattcagctactctatgtcctttgattggtgagtttagatcatttacattcaatgttattgttgataactaagtactggctcctgccatgtatttgttttctggttgttttgtggtcttctcttcatttgtttcttctttcctgtcttctttttagtaaaggtgattttccctgataacgtgttttcatttcttgtttgttatttttgtgtatctgttgtatgtgtttgtatttaaagttactacgttgcatatgtttgtatttaaaattactatgcatgaggcttgcaaataatatcttatactgatgacaacataacactgattgcctaagcaaacaaaccaaaaaaaaacagagaaaactagtaaaaatcttatattttaacattgtccacctacctttcaactttgtgtcatttctatttatatcttaggcactgtctatgtcttgaaaagctgtagtttttttttttaattggttcatcttttagtctttataagtagtttacacgccgtaatcacagtattataatattgtgtttttcttcgcactattatcagttagttttgcacctgcagataatttcttatttctcattaatgttcttttctttcacgctgaaaaattatcttttgcatttcttctaggacaggtctggtgttgaggaagtccctcatattttgtttgtctggggaagtcattatttccctttcatgtttgaagggtattttcactgagtacactattctagtattaacgtttttttttttttagcattttaaatatgtcatgctgctctctcatgacctgtaagatttgcactgaaaaagtctgctgctagactatattggtggtccatggtatgttatctgtttcttttgctgcttttagaatcctttctttatccttgaaattttgatttatccttgaagtttgattattgtcttgatgtagtcttctttgacttaaatatgcttggtattctataatcttcttttacttgaatattgatatctttctctaagtttgggaatttctctattatcatagctttgaataaactttcagccctatctctctctctacctcctctttaaggtcaataactcttaaagttgcccttttgaggctatattctagatcttgtatttgtgcttcattaatttttatccttttgtctcctctggtggtgtattttcaaatagcctgtcttcaagctcactgattcttctgcctcatcaattgtgaggttgaaaccctgatgcattcgtcagaatgtcaattgtattttcagctccaaaatttctgcttgattgtttttaattatttagctctcttccggattctgaatttcttggctgtgttgtcttgaattttgttgagtttcttcaaaacagatattttgagttctgtgtctgaaatgtcacacatctctctctctctctctgggattggcctctggtgctttatttggttcatttggtgaggtcatgttttcctgaatggtcttgagacttgtggatgtttgcctgtgtctgggcattgaagacttaagtatttattgtagtctttgcagtctgggcttgtttgtactcgcccttggaaagcttttcaggtatttgaatgtacttgggtgttgtaatctaagttttctatctctgaaaccttatctgcattagggagcaccccaagtccagtaattctgtggtccttgtggactcacagatatactgccttggtggtcttggataagatctgaaagaattctctggattatcaggcagagactcttgttctcttccttcactttcactcaaacaaacatctctgtctctctctctgctgaactacctggaactgaggagtagtggtacaagctccctgtggctgccatcactgagaccctaggtcagaaaaagccagcatgataatgggtctcacccaaggtccacagtaaccactgccttgcttgttgcctatgttcaaggccccagggatctacaatcagcatgtggaaaagtcagccagtcttatacccttcccttcagggtcacgaggccccctgaccccaggcacatccagagatgttatccaggagccagggcctggagtcagaaaccttggggatctaactggtgctctattctgctgcaactgagctggcattcaagtcacaagataaagttatttccactcttccctgccctttcacaaccagaggagtctctccctatggctaccaccgccccaggcccacagcaagaattgcctgactattgccaatgttcactcaaggcccaaggactctttagccagcttgtggtaaatgctgccaggcctgagactcttctttcagggcaatgggctctcctctggcccaggactggtccagaaatgcaatccaacagcaaagtcctggaatccgggaccccaggagcctactttgtgctctactccactgtggccaaggtggtagctaatctgcaagacaaaggctcctttattattccctctccttttatcaagcagaaggagcctctcctcatattcatcacagctgggaatgtgctgcatcacacctgaaaccagcatgtctcagattctcacctaagctctatggcaagtactacctgggcattgctgctgattattcagggcccaagtgctctttattcagcagatgatgaatctttctgggccttgttccttccccacaaggcagcaggttcccttctggcccatggtgtgtttagaaatgtcatccaggagctagggcctagaattggggcctcagtactctgctcattgccctatctgactatggctgagctggtgtctgattttcaagaaaaagtcctctttactcttccctctcctgtctttaagtggagagaaggtatattaggccattctagcattgctataaagaatacctgagactgggtaatttataagaaaagaggtttaattggctcatggttctgcaggctgtacaagaggcataacactggcatctgtttctgggaaggctccaaaagcttataagtatgcagaaggccaagggagagcaggcgcatcacatcgcaaaatcaggagcaagagatagagagtggagggtgtattagtctgttcttatcctgctaataaagacatacccaagacggggtaatttatttaaaaaaaaaaaaaaagaggtttaatagactcacagttccacatgtctggggaagccacgcaatcatgacagaaggtgaaggaagaccaaaggcatgtcttacatggcagcaggcaagagagctttcacaagggaactcccatttataaaatcatcagaactcctgagacttatttactatcatgagaacagtatggagaaaaccaccctcatgactcaattatctccacctggccctcgccttgatacatgatgattattacaattcaaggtgaaattgggtggggacacagagccaaaccatatctgagggggagctgccacacacttttaaatgacaagatcttgcaaaaactcactcactatcgtgaagacagcactaagccatgagggatctgcccccatgacccaaataccacccaccaggccccacctccatcactggggatgacaattcaacatgagacatgggtggggacaaatattcaatctctgtcattctgccttttttctctctcaaatctcacatccttctcacattgcaaaatacaatcatgcctttccaacagtctcccaaagtcttaactctttccagcattaactcaaaagtccaaagtctaatgcctcatttaagacaaagcacatctcttccaccttactagcctgtaaaattaaaaatatatatatttactcttaagatacaacaagagtataggcatggggtaaacattcttcttccaaaagggagaaattgggcaaaagaaaggtgctacaggcgccatgcaactttgaagcccatcaggagagtcattaaatctttttgtttgtttgtttgtttgtttgtttgtttttgagacagagtcttgctctgtcacccagactggagtgcagtggtgcgatctcagctcactgaaacctctgcctcctgggttcaagtgattctcctgcctcagcctcctgaatagctgggattacaggcacgtgccatcatgcctggttaatttccatagttttagtagagatgggatttcgccatgttggccaggctgttctcgaactcctgacctcaggtgatcttcctgtcttggccgcccaaagtgctgaaatgataggcatgagccactgcacccagccaaagtcattaaatcttaaatctccaatagttcttgactccatgttccacattcagggcacacactggtgcaaagggggactaccaaggtcttgggagttcttcgtctgtggctttccagagttcagcccccagggttgctttcacatgttgttgggtgttttggcttgtccaggcacagggtgcaagctgtcagtgacaatatcgatctggggtctggagggcagttgtcccctttccaaaactccactaggcaatgccccagtgggattctgtatggggcctccaacctctaatttcctctctgcatttccctaatagagattctctgtaaggtttccacccttgcagcaggcttctgcctgatcaccaaagattttccataattctctgaaatctagatgaaggctgccaagctttcttgattcttgcattatgtacacctgtaggcttaacaccacatggaagccaccaaggctatagcttgcattctccaaagtggcaactcaagctgtatctgggcccctttgagccacagctggagctggagcagctgggatgcaggccgatgtgttctgaggctgggcagagcagcaggaccctgggcctggcacacaaaactattcactcctcctaggcttcagggctggtgatgggaggtactgcctggaagatttctgaattgtcttcaggcaattttcccaaagtctttgctattagcacttggctcttttttaactatgttaatatctctaacaagtggtagctccacagcctgcttgaattcttctcccacaacattttctttatttgccacatggttaggctgcaaattttccaaacttttacactctgcttcctgtttaaatatacattccagctttcagtgttttctttgctctcacatctgagtgtaggctgttagaagcagccaggccacatcttcaacactttgctgcttataaatttcttccaccagatacactaggtcatcactcgcaagttcaaacttccacagattcctagggcagaggcaaaatgcacccaagttctttgctaaggcataacatgtgtgacctttgccccagttcccaataagtttctcatttccatctaagacctcaacagcctggacttcactttccatatcactatcagcattttggtcacaaccatttaaccagtctctcagaaattccaaactttccatcatattcctgtcttcttctgagccctctaaactcttccaacttttgcccattacccagttccaaagctgcttacacattttcagttatttttataacaatacccaacttcttgtatcaattttctgaattaggccattcttgcattgctgtaaagaaatacctgagactaggtcatttacaagaaaaatggtttaataggctcatggtttttcaggccgtacagaaggcataacaccagcatctgcttctggtgtagtctcaaaagcttacaatcatggaagaaagaaaaggggaggcaggcacattacatggtgaaaacaggaacaagagagagaaagagagtgtgtgggggagggagggaaggtcatttaaaacatacttttaaatgaccagatctcacaataattcattctctattctgaggacagcatcaagccataagggatctgcccccgtgatacaaacacccctcaccagcatggggattacaattcaacatgagatttgggtggggacaaatatccaaactatatccgaaggagtctcacctggagctgtgggctgtgctgcctgaggttggggatggggtggcataagcaatttcttggccaccccagctggtatctcactaggtcatgtgtccccaagtccactgactctgagttcagcacagcaccaagacttgcccaggaattgtagtccttgtggcctggactgtgtttcaagtttatttaggaccctaaggcactttagcccatggtagcgaggctagccagaactcaggttctgactgctgggataagtgattcccctctgactagggctggtctaaatgttcttccatgagtgctggctgagtcctgcctgctgttgctatccactgtgtgaggacagcaacgacttccaacacaaagtcccacagtcactgcactctccctaacccaaatgcacagactgtctctccaagccatatggccactgccaggggatgggggaggcatggtattggcaattcaagagtgtcttttctacctctttagtgcctctttcagtgatatgaagttaaaaccaggtactgtggtcacttagttgatttttggttcttatgaaggtgctattttgtgtggatagttgttcagtttgatgttcttgtttggaggaacagttaacgaaggcttctatttggccatcatgttctaccttcttcttaatcattctattgggtctgtagtgatatctctatgcatttttctataagtaattatatttacatttttttctgttttcattagtaatttctatctccttttttcaagtgtctgcttttaaatttgcctgttttaaaatcttacgttgtttgttcttatattactaatacgtataatatgtttgtattttttatataaaccttttgaccattaaatatattgagttagtcttctcccagagtggcctgcctttgtactttctgaatagtgtcttctcatgaactgaaattttctattttttgaagtttaattcatatatatttttccttttacagtgactactctttgcatttcaaggatatcttgcctataacagaattatgagttgttccattctgttacttactctactcctcctcattagtagccccatccctttttctttgtcatcacttgaaaatgctaaatctccaaaatcacaaattaaatattccactatctgcctacagcttcttatcctatcatacctgttctttgatattattgacatctcctctccactggtaaatattctttctatttcctagggtccctacagaatttctttactcattctagagcagatatgaggatgctacgtgttaaaaatcctagcttgcaaatagttattattttatattgatactcttaggcttccctttcatttacaaaaataaacaagaataaatgcactgatctctttggcatggcagaagctgaatgctgtcagagtaagtcacaccggcacaaactgttatcatgataaatacatagtcactaagcttacctgcctttatatccctgctttgagattatagtatggtccttttactagctcagtctttcaccctcctcaaatattgtttcaaatatttaagacttttttccagtccctaattcttctcttcttgcctcttaagccaaaggcacatcttgttaggacatgctggaccttgcatctctgcaattaacacagtttttctactgtgtgaaggtgtcaccttgagtgaagatggttcttgcggacgggaacccagtgtggggctcaactctaaagggatgtggcaatgggtctgaaaatgggttctcaatgaagcatcacagtgtccactatgtttatgaagtagatccaccctgccacagacttctaggtaagagtaggtgatcatgcatcatgattctctactagaacctctttagattccatgtactcaagtcatactatttattttcatactgcatattttaatgcttctcccaactcttttggtaatgctaattgcatgtgatagaattttcgttactgctatttgcaaagagtgagaaattgtattatttctaattgcagaatgttagaacttgtattattttgttaaagcaaaataagatctccaagactcacttttccattgctatgtctattaaccatggtcctggaggtattgaggagggatgaaaagacaatttacaaaactgtggcaaggttaaggaacccagtaagagaagagaaaggattatggggatagtatagtgagtgctcttattcacattggcctaaaagaagtaggagagtgtgtggatctcggggcttttgacattttacatttggggtaaggatgtttgtagggtgctgtgacctttggtagagaaaagcaatcaatatgaaatagtccagcaaggaggcagccaggagacacacaaaccgggacagttggttaccctctctctctctctctcctgccattgtctctcataagacaaactcactctggagtacacaaaaagagatgcagttactataatccattggcatcaacctctgaaggcaggatggatctggagggataaacataacctgcccagaggatgactcatagggtggccttgtgggtgctgaatcccaagtggttaggtctgtgctgtgagctgataaagccccagaattatttatggggaatctatactcctaataatttacagacaacacagatccactttggacttgatcagatggacaaaatcttggggacttgacatcactgcgcacacaggggaggagctgggattgttgtccaggaaaggaaaatataaggagaaaccttggtttgaatttggtgtcagacatatgatgagaggacagccaggaagatctggaacatgaagatttaattacaggccactaactctcagctgacgggcaggtctgtgagttccagaatggagcactgcagcagtaggtggggaggaggctgagagggcgatgaggcagtctgagtgctgagggcagtgcagtcagagaagcaactgcctcatcacagaagcttctgcccttactcagcccccttgctctgcaggatgaggagggagttccatgggtagggaccactggacctaaggaagcctgaaggggaaggaccacaggacagtgacatcacaggatatccttcctatcaggaaaagtgaggctcagaactcagctcttcctgggaggaccaagccctgagcacaggtgcagtgctgcctgctccgctgtgccatgggctccggactcctctgctggacgctgctttgtttcctgggagcaggtgaatcctgtggacaggacagcacccctattctcagcttgcccacccctgtgtcccccacttcaccatggggaggcacaagttcattctccacctattttttcctcaggcccagtggaggctggaatcacccaagctccaagacacctgatcaaaacaagagaccagcaagtgacactgagatgctcccctgcctctgggcataactgtgtgtcctggtacctacgaactccaagtcagcccctctagttattgttacaatattgtaataggttacaaagagcaaaaggaaacttgcctaattgattctcagctcaccacgtccataactattactgagtcaaacacggagctaggggactcagccctgtatctctgtgccagcaacttgatgcaggcctgcagagccaagaacattctgtgtacaaacatccctgccccagtgtggagaacttcagccctaacatatctgtgagaacttgaggactgtagtgggaaagaaaagcagtttcaggaagctggatcctaaaacctggggttttctgccagttaggagtggggataacaaagccaagagggtctgctcaggaggtggtgaaaactaccttcttcgccaaacgctgtacactatagggatagtggaagtgtttgtaatttaatagctggtgccctctttacagggcagcagatttaatttcagggtcaagattcttgataatagtgtggaagggaaaatcatagggtttgctttatataattcagggagaagaaagtgagatttggggaaattctatgaaagagaaaatgatcaaagatagttgaaaacagagatagagcagaaggtaatgaaacatggtgatctgtgcaccatgagctcccttctcctcccacagtttttgatatccagaaaatacaaagaaaggtcttatagcaactgacatcacctggggactggtcctagttggggatatcacaaatagcagcctgcctgatgtgagggccttggggttggttctgacatcttctttctcgacttctggatctagtcttgcctgctcgaggcacagtcaaatacttcccaaaacacaaaggaggtcaggtcagtcttggtcctaaaggtgcaaatgctgtccgttttctcccaagataaaattctgcatccctgggattcctctctgagactcagtgcccagattcaattaccttctgtaattaaacagttctttgaacattttctaaaactcatcagccttggtatcatctgcatttctgctatttccttggcctggaaacttttgttctctccagacacatccagcccctgctcatctgtcaaggatggtctcacatctgccttactctttgcttcttaccctgacattccctggaactggactgtatcaatttatttatttacttttttaagacaagagtctcactctgttgcctgggctggagtgcagtggcatgatcttggctcactgcaacctccatccccccggttcaagctattctcatgcctcagccttgagagtagctggaattacaggcacatgccatcatgcatggctaatttgttttgtattattagtagagacacggtttcaccatgatggccaagctagtctcaagctcctgacctcaagtgatccccacgcctcagcctcccaagtgctgggattacaggcatgagtcactgcgcccagccctggactgtatcactttcttttctttattttcataagaaaagccaagtttataattaatagtatctgaagtttgtaaaatgaaaaagttaatgcatacttatatagaatcctggaatatcattaatcaccatcttcccttcaatgggactcctctttcttaaaatgtaatgaagattcttagagacagtgtcagtttttcatataatttctgcaatattctaagcaattgtgtcttcatagtcagaattgataaccaatgctataaagtatcctaactctaaggctggaatttgcaaatactcttttggagcaaataaaattgtgttgtagtaatattcatccagtctcatgatcctgaaaaaacaaattattcagcataaccacactttccacagccacatttttagagatttgatgagactggaacatcatcaaagatgcttctcagaaatcaacctaaaaaactgaaataaaaattagttaagctcagtaatggaatcttatcatcctttctgagtaaaagatattgtgtgtgcaggaacagaaaaccaaacaccacatgttctcattcataagtgggagttgaacaatgagaacacatggacatagggaggggaacatcacacaccggggcctgtcggggggttgggggaaggggagggagagcattaggacaaatccctaatgcacgcggggcttaaagcctagatgacaggttgatgggtacagcaaaccaccgaggcacatgtatacttatgtaacaaacctgcacgttctgcacatgtatcccagaacttaaagtaaaataaaaaaaaaaaaacccaagatattgtgtgtgtgtgtgtgtgtgtgtgtgtgtgtttgtgtgtgtgtttgtgtgtgttttctgtggagactcagccgcatggaaatagtttctcagggtggcattactaagaggtgttgggtcattggcagagctcctaggtacttctgggtaaagaaaggaaatatcagacccaattgaatctgcctaagttatatacagctcatagggtcgtttatttcaagattttttaaaattcagaaataaatttgtaaaattgaaaaatcctctttatagaatgtgctatctaaaatctgggaataataaatctaaatataggccagacgcggtggtttacacctgtaatcccagcactttgggaggccgaggcgggtggatcacgagatcgagagatcgagaccatcctggccaacatggtgaaactccgtctctactaaaaatacaaaaattagctgggcatggtgacaggcacctgtagtcccagctgctcaggaggctgaggcaggagaatggcttgaacccaggaggtggaggttgcagtgagctgagattgcgccactgcactccagcctgggtgacagagcaaaacagcgtctcaaaaaaaaaaaaaaaaaaaaaaaaaaaagtctaaatacaaagtgtgaaaaggtgtggctctgattattcaaagggagctctggaatgtcgtgtttccagtctggatctgcttgatatcctcacactgtttcaccctgtggcctgtataattctggctcctctcttccatcttaggatactcattgcaatgatgtagcagcagtttattgtgcaatcaagatgtgcccttttgttttcactggccaagggtgaatttgaagttccaccctaagtcaacccttctgggaaagcaatagagagtgtgtgtgtgagagggtgtgggttgcaggggttggtgtaggggcatctctgctcctgacttagacaatgctgagctcatcaggtcagaaggtgtgaatccatgagactggaactttggccacttggaggtgctgtggctccacaaagctgtggggaaccctggggaggggtggagggtgacccaggagaggacggctgaagggaatgcttggctgcgtgctggcatcaggaggcggttggaattcagagtaggtcctgggactgcccagggcaaggtaggcacaccagggacctcagtttgcatcaaggagagaatgtctttgcctctgcatgggcagtggagggtgaagaggctggggcagcaagggctgggagtcagtgccaggaaagtgacaggggttgtcagagaaaaataaggtgggatatgggcatgtggagactgtgttccacctgccccacttttaatttcagggttgtgtaggacaggaatggtgcaggaagcagcagagcctggggtctgacaatgggtagagcaggcaggggtggcctgcagggagagttactgggaaaggccggtttcccaaggaaatgcctgaaacattcctgccccactcaggaaatgaccatgaggtgggtgctgccagacagaggggttcaggccctgcagagctgacaggcctttcccaggcactccctgctgcttctacatgtgatctgctttaatgcccactgatatcaggcagggtaaatatgattttacctgtttatacatatgggggaagcagctgtccctgttctcatgtttagtaactggctatagtcagttcctccaacacctctgcacgccgccctgctctgtacatgtgtcctctcctctggcttcctcatttcagatccccgttagcaggagggaaagatcatgtctcatatgtggtcattaaaacctcttccccgacaagcccaaggaacttccaggtcaagcatctacattcatccttcactgtaggaaagaaaaagaaataaaattttctgcactgtggactttctgtaactgatgtaatataccttgaggaaaatgagcataaatagttgctattcattaattaattaatcttattcttttactcaataaactttttgaggatccttctttgtataaggtattctgtgacataaaattgaaaagaaaaaatattaagtggaaaaaatgtttcttgctttttacagtgttaaggtttgcatttattttttaaattgttttctttattaaaaatagtttactgatttctaaattatacaaatttacttttttctctttttttggctaactagtcccattttagacagccatttaatttaactgtggtaggaatatgtaatatgaaatatatctttttaacagatttttgtatgtacaatacggtattgtaatctacgggcaaaaggttgtacggcaatctctagatcttattcatcctccttaactgaaattgtataccattgacagcaactctccatttactccaatccccagcccttggaaattaccttcacctttgcttccgatacttcgattatttacgttccatcatataagcagaatcatgtggtatttgcctttctgtgcctggcttattcacttagtgtaatgtcctgtgggtttatccacattgtcatatatggctggattttcctctttttaaatgtttaaaatacttctttgtatgcatctaacatgtttaagttctgaagtataaaatgtgtcatatctgactgtttctatgaaacagtctgtcacatgactggcagtcatttgcagaactgcaagcactgagtacactgatgcacattcacagttcaattctgcttcatggagaagacttagagaaaatattaatctaatcattcattatcattttatgatgcacaaaatagaaagccttcattaggaaaatttcaattaattagaaattcaactatacgaaaacatcttaacgtgtaaacgctattctcattttacaggtagaggaattggcccatagtttaaattacttgaccaaattaagtaggaattaggatgcagtactggggttctaaccctggtctatcaaagccctgttttttatagctatatactataatctatttcataacaaatgatgcttatcttcacaaaaattcaaatgttatctcctaggtccctttcagacctgctggctctaataacatcatagacagaaatcagtttaccctggagaggggggggtgggaaacaactatgaatgggtgccatgacatcaagcctgactcccattctagcaccagctcctcaagacgtgaggccagttcttgacagatttggcttagtttgttttctgtttttttgtttttgtttttgttgttgtttttgtttgtttgttttaatctatgaaatgagactgctactgtccatccgcaggctgtgtacaaaattaaatagcataaagtatctagcatgtagcagaaatctagatattaggttggtgcaaaactaattgaggtttttgccgttacttttagttacttttaatggtaagaactgcaatacttttgtaccaacataatattttaatttcctttgataatctcagatagcctctttcaccatgccaatgtgcaaaggcagatgcggacatatgatacctagaaatcttaggttgaggattcagaagtcacagaaatggaaatgtacatttcctctgatgatttatttgatgaaattaactaattaactaaagaatgcagtatggatccctcttgaggtatttaaaaaatcaatgttgttgacatataaattatacaatgtaaacattatacatcttaaatgaacagatcagtgatttttgagcaatatatatgtatatgcccttataatccccacccctcttaaaatgtaaaatatccccacccctattaaaatgtagactatctccagaaagttccctcgaacacctctgcaatgcctatcttggtcccagaaaaccaatgatgtaacttctatcactggagagtagttttgttcacaaatatttttaatgtcaatttaaaacccatactgattaatcctcttgaatacatagctaaataatcaaggcaaggaagagtttctgggaggttttatggttttagaagggattgaaaccatgagagctaccttgatccatggtaggaacgattctatctggagatggatgttgtgccgaaataacctcaaaaggtcttttcagctggtagaagctgattcgacaacatttatttattcattttcattcatttctttgcttctccattcattaactcaaattgtttagtaatgatatcctgataacagttaattatctccaaggaaattattttgagttcccataggacacacatgcagctggttttgtgttcacacactgagaacgctggcgtcaagcaaaccatggtaacagagacttcattgaaagatgatgttacattgggagaagcattctttttgccttaaccccaagtgtttaactcataaatcctgagccttcagctagaattcatcttcctgttctggccctgtcctgggcaccaggatcctgagctgtgtgttcctgtctcttgaaccacaggagtcctgggcacgcacatgaaacccactaatgggcttgttggatcccagctgtgactttcagcaccaggtggcccttagctgtgactttaatttctgtgtccttcactgctaagtgaagccccatagacgctgaatgaccagatcttggtgatgcattgtgctgaaaggaaaccagcacagggggaggtgagcagaatatgaaacaaaatcatgtatttacaaccagcgacatgacttactggcagatcctttgttcaaacactattaagaatttaaaaatcatgacagcagagtgataaagcaagcgtgggatccttctgaatgcagggctctgtacaccgaagatacagtttttgagctccttttcatttattactaaattaatggcaggaatcctgaacgaagggatattccctatgagacatgacacctcaaataaaacgagagcatttttccttatcttgaagtctgctccctctcgccaagtccctcactcatcaggacacctttgtgctcacaagtcttcagcagcgctgggtggccaccattgtccacacagagagggcagtcagcagcatgaggtggttctgcctgctgtggtctcaccccaggaacagaaagcaagactcctggatggagctgaaggtgctcagctggacttgtcaggagtcccatctgtcagtgaattgacaagaaacagagcaaaactactcctgcaatgttgatgagcctgcccctgggatttggaaacctgataacagagaaaaccaatatagacacaggactttaacaggattatggtcaattaagcagattggaaaaggatacttgaaggagtgtttgggacacaggaatcaaaaacaccagggagacaagaggatttttcctaagattctagactacagcaatacatagataactaacaccagaatattaatgaggaattatatcattgcaggaataaaatttatattgaattacaaactgtttgcacaaaagtcaagaaaaacttgaaagccttatatcaagaagcattcttcccatccaaacttcagtggtgcatttattttggatttgaccctctggggaaggggcatggcctctctcgacaagaaggttctggggaccaggcagagagaatgaggtctcaggatgacttccttgacagccctgttcgcctttcatcaacacacagacccagaagacctctctgtcttgtagcatctgccatgagaatcaggctcctgtgctgtgtggccttttctctcctgtgggcaggtaagtcctgggcagggcccatgtgtagatttcaagacccagagccttcccattgaggctgcagcattggctttgttctccttctctgtaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgactccacagtgctgcacagccatctcctctctgtacataaatgcaggggaggctctgccctcctccccgaccccagactcaaccatgtccttggcagagttctcagcactgggaatcttggaagcccaatgggtgccgggcagtgtgagcctcagtctgtgccaggtgcctctgcaggcagtcccagccaggcctggactggtcccagagcctcagaggtctcttttgttgctctctggtctttcttccaagctatctttttgggatgggaccagggctttcccagctcttacttttctactcatcatcctgagtctgaggtccacaggatggaacaggatttgtatttcaaatctgtctagactcctgtttctctctgggggccacgttgcttcctctctccagggtttcctccagtacccactctcatgtggtctcacctgtggcccgcctttcccatctgagcagtcacccccgaaggccttgctgggcctctgcacaccacctcccctcgcctttctactgcagccatgaggctgcctcttctgtgcctccttcctttccaacacagagacctcaaaggccatttcctccgccctgggctagtgccttcctttctgcagtggtcagcttctacctgcacttctgatctcagcatgatcagcctctcctgctggaagcactccctcaactctcagctgaggtcaaatttcagtttccctctcataagctcacagaatcatgtgcctcttagtaaagttcagcaccgttgcaatttttccaacacttgttttattccttttgtgctccacttaattttaaactcatgaagctgaaggctgagcttgttacattcaccaccagcagtgcctggcaggcagggagtcctcattcatttcacagagaatggatgagtgagtgacaggtgagtgagtgatgagtgggtgaatgaaccagtaacaggaacacactagattcattgtaccctggcagaggtctagagttaactttgcctgagatgctctgttatgagctcatcaaggagcactcacttgttgaacaagcataggaccatgcatggtgcaagccagtttgtcagtctgggaatttccaatttaaaatatgatgtgttcttcaagctgaatgagggtaaactttctgtatataattataatatctaagccatttcttaaagttttgggttaggaacaaaaaacccctgaagagggaacatttgtagatttaggatttttaaaatatatttatattattttcccttggaagaacaggatgggaacagccttatagttgctaatttgtggagaaggcatcatataaaagtaagagaaaatcagaattgtgttctagagggtaaattgtggctgtcctgagagcatgttccccaggaacctaaaccgtgagcatgttcaggaacccagagtgcaacagacaattcttggccccatgaatttggtggtaagactggagacagttggaaaaaccatggagtcttgaagttcttcactctcaatgcaggcctctcttgaacaccacagactaatgtcagataaatatgcttccactattaagactattaaaacaagaaccaatgaagagaagtgagcagaaacaataagcaattgaagtgtttgaagacaagaaatttttaccattaaaaggtatgaaagtttgtagaactatgtttaaaggaaattgaaatgtgaacaagaaaaaaagactgacagaaaccatcaagataacattaaaaaataatcaaattcaatacagaaatgattaagattatcactgaaaacaaaatggaaatgaagaaagatgaaatgcttctaagagattattagtgatgtcaaggacagagctgaagaagttacatagaatgcagcaccgaaaattaaatatgtaactttagaaagagcttaagggtggtttccagcatagtagaatatataatttttaattatatatatttatttatataaagttatttatatttatatatttaattatatatttattatataaaaatatataatataataatatagaatatagaatatatattctataatatagaatatagaatatatattatataatatagaatatagaatatatattatataatatagaatatagaatatattatatagaatatataaatatatatatttcccatttttcttatagataattgaagtttcagaaaaagaaagtagagggaataagtgattgtgatgagacattagctgagaattttccagaggtgtttcaggacctaaattctcaatttcaagaattcaaatgaatatgaaataagataaatgtttatattataatgagattgtggaacataagtgacaaatagatgattctaaaagctgtcaaaaagaaaagataaatctctcctagtggaatagactgaaaaaatcaatgaaagaaagaggatcagaaataaccatttagtcggaattataatccccattcattaaacactgagatggaggaaaatatatttacaagtggaaaaattaaaaaaaaagactatgagttttccaataaggtatcttttctgaattatagtcaacaaaggtgggaagtggtcccagaagaaaggcatgaggtgcagcttgtgagggaacccatgtgttgggacagccccgttgggcacgtgtgactgggggatggaggaggctggggcatcaatggggatggcataggggaccctgacttgcagaaaagacaatgagctcatcccttggtgccttgtgttgggggcgctgttggcacatcctagagaacatgcccagcagacagaggagcgcctgtgtggtgaggagataaactcagaaatgcagcatgaggcctgtagctccagacagctctagagcacaaagtgaagaccgatgcattgatgttgtttaaaaggagctaataaatatctaaagcagtcatccaagtgtgttctaatataaatcctgtgttcctgaggttgtggggattgagagaggaagtgatgtcactgtgggtactgttctgtgtcaggacaaggacgtccctcctcctctgctcctgctcacagtgaccctgatctggtaaagctcccatcctgccctgactctgtcatgggcaccaggctcctctgctgggcagccctgtgcctcctgggggcaggtgagtcctcagacaccaaccagtctcattctgtgtgtctgtatgtgtgtgtgtgtgtgtgatgagtacaactgttttcctcatcctgttctcaacttgtgtctccgcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcttaaccacagcatgacacaatcgcctccttcctgctcataaacctcctcctctctctccttgcttccttatgatactattttgcaccaggggatcctcatctcacaccactccactgcctcttccagaatcattgcttgcatgtccgctgctcagatcagcagatgtgcgttgtatatgttaatcattttctgtggaaggctcgttgctggtcttcattatccatccttattttccacattggatactgctcccttcaagattacttgttgcctacaagggatcctactttttacattcaaattttactttttattaatacgtatttgatgccatcttgaaggcaatctcattatcatcctaatcttttgctaatctttatgtttacggtaacattgattgttattttgggggacatgtatttcatctttggtaatgaaatgaaataactatgcacttcaattcctgtatgttctgcctacttaagagtaaatccaattttcttccattcctcccattctatcccactccctttatatgatagttttaagggagaaaatattaattagactctaactgcagctatgtgataagagttatttagaatgagggtgggatattaagctttgagtaaagcaatagtcagggttagaactagtgttggaatcagggtttagggaagttgctcataaaacctgcaggatgacacttctagaatagtctctcactcactctgcagacacttcccagcatcccttgggccattgcaaaagcaatgatgaaacttcacgtgttggccacaagatggcactgtggtccactgggatctaagggactctggggagagcctgggagagcagcctaggaagggaagggttaagaaaaattagggctggcatccaatattatgcagatgttgcagcagttttcagtcattgctaggctacctacagctatgcaagatgcaggaaatacctctaatctttaatgagatccacagttgaagaattttggcctggcagccttggtgtcaagcgcaggtgcaagcagaggagcaactgcctcaaaggaacgtgggaaagctaggggcgggctgtgccctaagctcagtatgtctctgctgcaccccatcttccctgcagacctcgccgggcaacagccttcatgagaggaggtggatcctgcctgagaccagtcagaaggccctggaccagctggactccgtaggcatggggggtgacaccacaggcccaccagactattccctagggagcagcctccaagccccagctcacagtcctgaggatcactgcacttagttgggccagcccctcctcactctgaccctaccatgaaccccaaactcttctgtgtgaccctttgtctcctgggagcagataagttctggaaacagctgcaaaaccctgtaatgggtttgcaatgtctgggctacaagccttttttgtcctttcctctgcagagtccccttatttcttaagtcttgtcttcactttctgtctgcctctccagcaggctctattgatgctgggatcacccagatgccaagatatcacattgtacagaagaaagagatgatcctggaatgtgctcaggttaggaacagtgttctgatatcgacaggacccaagacgggggctgaagcttatccactattcaggcagtggtcacagcaggaccaaagttgatgtcacagaggggtactgtgtttcttgaaacaagcttgagcatttccccaatcctggcatccaccagcaccagccagacctatctgtaccactgtggcagcacatccgcagccctgcacagccagctgccctctgcacaaaaagggcagtcacaggctggaggtgggcactccttatggaagcccgtgtctcaaccagaagaaaaagctgccctttctgaagctcttcccagacttcccagcaatgagatctcattctatgtgtgctcctgcagcataaaacttagagtgagctgggtctgtcactgtagtgcggatgtgtaaatgcaaacaacgtaatgttattttgctcaatttggaatattctggtaattgtgcaaaggaatggtagcttctaacaagaaattcatatttcactttcttttcaggagagaagaaaaaagcagaaagcagctgggaagctttagcctgcttgagtgatctgggattctcaagtagcatacataacatcaccttggctttggttcctttagataccaagcatgtgttctgtggaggacaagaaaatccatttttttttgttataaagttataaacacacaagagaacaatccagttagggagaatgttaataaatacaacaaactctgccattagacctgaagataatcagctagtagaattatcaaagagattgtaagactcttactgagtacctgtttgaggtcctctgaggatagatgaaggaaggaacttaattcttaccatcactgtggcttggattagaatccatgagttccttaacttgtttttcttgtaaaatattataaaataatatagaacacacattttattttcctgtagcctgtagtcctctttagcacctaaagggagaagcgcatatcccggtgcaaaagggagctggttgcttgcttggcaaaaaaatgaattcaccaattggccaatctgctgaaagtcaaaatgaaaggctaatatatgagactgatgacagttcatggttcttggtataacttcaacagcgagtgaacatttttttctttgtctatagctttctttcagccatcgatcctcagttgtgtcttagcctcttatcagtccagctcactttgatactaaatttgattgttgtgtatctcagcaagaagcacgtctcacattctctgtattttatgtggtcatgagtgtgttcctgtcttattcttattttatgtggtgcatttttaaataggactgtacagaatacaagcatctatttgtatatgactctcatcttttatggggagaggtcagagtaggtgagcgtgcactttgattctctgctggaatctctttggattctatgtcccctgtcacatggtttattttcatatgcatatttctcatggttctcctgactcttttagcaatgctcattgcaggatattagaaattgtattacttctaatggcagaatgttagaaattgtgttgactcttaaggcaaaataaaatacccggactcacctttccattgctgtgtctattagtcgtggtcctggagatatcaaggagggacaaaaggagtatttgcaaaggtgtggcagggttaagggaacccagtaagagaagtagaagtagcctaagaacagcagaatctgtggctcttattcacattggcctgaaataagtaggagaggatgtggatcccaaagcatcaggtactgtagctctaaggcaaggctgcctataaggtgctgtggactttggtagggaaaagtaacctatataaaataatgaagcaagaggagagccagggcatagatgaatcagaacaagtggtgcccctacctccctctactctcctgccattgtctcccattagccaaactcactctggagttagagaagaagagagccagttaacataatacactgaggtcagcctctgaaggcagggtggatctggagaaattaacgtaaattatccagatcactacgcataagatggccttgagggtgctgaatcccaaactgtctggctaggtctgtgctgtgagctgataaagccctagtgttatttctggggaatctgtactcttaataatttacagacaaccaaggtctgctttggatctgatcagatagactaaatcttggggactttgcaccactggccactcaagggaggggctggaaatattttctgaggacaaaaaaatagaattagaaaatttggttgaatctagcgtcagagagatgacattaggacagccagggagagctggaacaagaaggtttaatcacaggctcctcaccctctgctgatgggcaggtgtgtgagctccagcatggagcacgacagcactaggtgggaggagggtgagagggtgatggggcagcctgggagctggagcagtgtaggcagaggagcaactgtctcatcacagaagcttctgccctcacccaacccttctgctggacagggagggagttcaggttgtggggagtactggacctcaggaagcatttatagggaggacacaggacagtgacatcacaggatatcccacccatcaggaaaatcaaggcccagaactcacttggcccttccccaggaggaccaagccctgaatcagatgcagtgctgcctgccccactgtgccatgggccccgggctcctctgctgggaactgctttatctcctgggagcagatgagtcctgtgcacagaacagcagccccattctcagatttcccacccctgtgtcctccactttacactggggaggacctccaggctgtctgctgtgctcatcctccatctgcttttcccacaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaagcttggcacagccctgcagagtcactggaactctgtgcactaatctctctgcttccgtgtacagcagtctcagaccagacagctgtgagaacctggggccttcagggggaaagataaacaatttcaggactctgaacaaggctggcggaaacaaggccaggaggatatgctcagaggatggtgctgcttcaggaggttcacggcaaaattactttctttgtcggatgctgtacactatagtgatagagtagctggcactctcctttttagaaaaagaaattcattttggtgtcaggattgttcgacagatgtgtagtatagaaggtaaaatctcaagggtttgctttatataattaagggagaagaaattgagatttggtttggagaaacttgaggagagagaacatgattaaagattattaaataaatagaagtagagctaccagatgataaaaaattgtgttctctgcaacataacctgtcaaagttttcaattgctagaaaatacgcagcaaggccttgtagcaactggcatcaccccgaggccactctatgatggtcatcaccacgtagccagttgccctgtgggagggccctggagctggttccaatgtcttccttctggacttatatctcaattctcaaaacagaggaattcatttcactgctgatggtaaacagataaaggctctcccatttccccaaagatacattctgcttcccttgtatctctttctgacacttaccgcccagatccattaccttctgtgatcaaacacctcttcgaatatttcctaaaactctgcagcctttacattctctgcatttgtgctcagtatttccatggcctggaaggaccttctgtctcccaagaaacagccagaccctgcttatcggtcaaggatgggctcacacctgcttcctctttgcttcttaccatgacattccccagcattgtactataccaccatctttattattttcataggaaaagccaagtattaattaaatatataatgaatattatttgatgttgtgaaatctatgttaattcctgcttatatagagttctggaatattattacttttattcatgtgagggatattattaaccactaactatttcctggttagagatcaaagtcacttctgtgtaatgatagcaaatgtgagaaccagctgaatctgtttgaattacagctggcagtattattcatttcaaaatttttataatttagaagtaaatttttaaaatctagaaatccttttgtgaaatgcactgtctaaaatttagtaataatgaacctaaatacaaaatatgaaaacatatgggtgtaattaactgggattagctgtggaatatagggtttccaggctgggtttccttgatagcatcacactgtttaattgtatggcctttataattctggctggtctctaccatcttaacatattatttgcaattatgtaacaattgtttattttgtaatcaaaatgttggttcatgtgtcctttgactccattggctaagggtagatttgaaaatcaaccctaaattgactcttctgggaaagcatggacggggtgtgtaagagggtgggagtggcaggagtgggggcatctctctttctgatttggacaatttgagcatatcacgtcagagggtatgaatccatgagactgtagactgttggccacttggaggcgctgtggctccacagtgctgcagagaactcagcggaggggtgggagagtggccaagagaggaggactgaaggggatgccctggctgcctgctggcatcagtagagtggatggaattccctgagtggggcctggccatgtagagttaagcacagactatcattgccttgaaagagttggggtgccagaggcctcagtttgcatcaaggagggagtgtctctgctgctgcacgggcagtggagggtgaaggggctggggtggcaagggctggggaatcagtgtcagggcagggacagggcgggcagaggaaagtaaggtgtgatgtgggtatgttggtactgtgttcagtcctcctcacctttagcttctggcctgtgcaagacaggaatagtacatggagtagcagaacctgaggcctgccaaagagtacagtgggctggagtggcctgcaggggaaagtatgtcagtgtggtgacatcacaggtcaatgctcctatcaggaagaagggagcttaggaacttcagaatgcttactacagagacaccagccccaagctaggagatcctgccatgggcttcaggctcctctgctgtgtggccttttgtctcctgggagcaggtgagtcctgggcacaacttgaaagtctccgatcttcatttcttgtccctgaaatgcatgtgggccaacgatggcttcagcaggaggctttcttctgtgccttatggttaacttttgtcttctgacacacaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtagcacagccctgcatgagcatcagccttctgtgcaataacattcctgccccactcaggaagtgacggtgaggggagggctgccagccagaggggctcaggccctggagagtggacaggcctttcccaggcactctctggtgcttctgtatgtgatctggtttactgctcactgaagctgtgtaagcgaaatattattttacctgtttatatatctgagggacagcagatgtcctggggctcatatttagtagctagctgaagtctattgtttcaacacctctgcactgtccctcctcactccggagatctgtccttttacctggtgtcccctttttgtgtccccaagagcaggatgctaaggtcatatatgaaactgtgatcatgataacttgttccctgacaagtccaatggacacatgatttccaggcaaaacatatccatctattctttattgtgatttaaaaaaaaaagaaagaaaagaaaggtgcagttttctgctctgtagccctcctatgggcaaggccaggtcatctcttttatggagactgtatgaggagggagctttcctaggttcacagcaaatagcaggaaacgttttttatggggcgtgtagtcttcctgtggcggatgcaatctgccatcagtgaaaggacatgaaaaattgttattcattagttaatattttttattcttttttttttttgagacagagtttcactcttgttgcccaggctggagtgcagtggtgctatcttggctcactgcaacctccacctcttgggttcaagagattctcctgccttagcctcccaggtggcctccaccacacctggccagttttgtgtttttagtagaggtggggtttctctttggtggccaggctggtctcaaactcccaatctcaggtgatcacctgccttggcttcccaacgtgctgggattatagagccattgcactaggccaattttttattctttatcaataaatcttttggggcatcctactttgtacaagggattatatcacatgaaatatacaatgaaaaaagataattggaaaaaagggaaattttttaaaaatgaagaaaagggtgtttcttgcatttgagggtatcaaagtctgtaatttttggtatattctaattagtttactcagtttctgatttatacgaatttcctctttcttctctttctctctttggctacctacacacttttgccagattttttaaagtttttagtaacaatatttaacatgagatctaccctttttatagacttataagcacacaatacagttttatactctgtagtcataacgttgtacagcagatctctagatcttattcatcttgcatgattgaaattttatacccattggcagcaactccccatttaccccattccccagaccctgaccgctaccattctagtctttgcttccatgagttggactattttagataactcatgtaaatgacattatgcagatttttgtctttttgtgattggcttatctcatttagcctaatgtcctaccaagtatagtggtgacagttttacttctatcttccacagttcactcgaatagctccttgaccaactgtaacccagaatcataaagataaaggcattcttagaaatataacttcttgtcctggctaagttaacttaacacaacccggtacgggatggattctcccaggttgaggcatctggtcacatacgagtttcaacctatcatggtctccaggatccatttttggcggcaccactgctgcccaggtgactgtggacacaacttagatgtctctgtcctagattttccaggccccagctactggcttttcttttaacctgtgccggcagtctccctccactcagacgcagggatctgcctcctgctcccatctccttcctgaacttccgccctgctggagttgcatggatatcagggcccctggtcaatgtgcggcagcccacggaggcactgggagggaagctcacctctagctgccttctggggcccagttctgttataccccaagcaagtgctctgttctccctttgggctccacagtatgagaaatgcacttcatggattcatagctgacccctagctcagtaatctgatgacaaactttgagtttcactcaaagtgaaactctcagagctgagggactagctctgcatttctctgatgagggtaagaatacagtgctgtagagatgccttcttccctgtgtagacctggcactaaacaggaaaaaccagacagggtaaaagtgcccaaatatgtctgagaagactgaaagaaaatttcctaagaaaatccttctcctgacttcattcagttcctagtaagacacacctcaccctctgacccccatatcagctggtccccccaggatatcacacgtcctagtatctaaccccacagcaactaattcagatactggcctctttccaacctccagaaacggtcttgccaatagagttttgttggccgggcgtggtggctcacgcctgtaatcccagcactttgggagcccgaggtctggtctggtcacctgaggtcaggagttccagaccagcctggccaacatattgtgaaactccgttccttccaaaaaaaaaaaattacaaaaattagctggtcatggtggcacatacctgtgggaagctgaggcaggagaattgcttaaacccaggaggcagaggttgctgtgagctgagatctcatcactgcacactccagcctgggcaacagagcaagactccatctcttaaaaaaaaaaaaaaaagagttttgtcctctgaccaccaggtctatctagatatctaggcagatttaatttacgattaatttgacctcttaatcccattaaagggagaatgaagagcgtatggtttcaatgtaaagtatattcattttattttgaatgagttggaactaagtagtaaactgaggatatcactccattatagtcttaaaacaacccatggtaaaacaaatctctttactaggactttctttttcacattttagttcctagttacccagagtccagaatagttaagagttgaagagtcatgactgagatggtctgtgggggtttataaatgagcattcacttgttgaacaagcctagggccactctctatggaagcagtttgtcagctggtttgggaatttttaatttaaaatatggtacgttctttatcttgtataagtataaagtctacaaatataatttgcatatataggctagtgcctgaagatttgggtaggacaaaaaggaaagaagagataatatttgcagatttaggaagtttcattatataaaacttcaagggctcaggggctctaatttgtgaagatagtataatgaagaagaattagaaaatcagaactctcttctggagcctacactggggttgtcctgagaaaagattatgatatgaggaacataatccatggtgtgcttagcagcccagagtgtagcagacagttcttgactcatgcagttgggggggtgagactggagacacttgtggaaggtactggctgttgaggctgtgctatagcctctccaaaaccccatagatgaatgtcagacaaatatactgccactatgaagaatattaaaagttagcagaattcataaacactcgcaataggcagcctgaaggtttaaattttagcatcatgacatatgacagtttgaagagctgtagttaaatgcacacaaaagagaattgaaacctgaacaagaaaaaagagactctcagaaatcattagataacttttttaaaagcattgaatgggatgtctagaaatgatccctaaaatgactgaaagaaagcagataaattgaagagcagattaaatgctcattgaagagattattattgacttcaaagacaaatcttaagaagttacccaaaacaacacaaaaaattaaatgtataatatgaaacagagaggaagcaacagagaagaaacaatggaggtttcagttatattcgaatatatgtaacatttcataagaattttccatttattcttatgtcattgaagtgtcagagaaagaaaataaggagaatgatatgaggtgatattgtgtgtgatgctagctgagaaatttccagagacatctaaagacctaaaacgtgagtttcaagaattcagataaatcccaggttaaatagttacctcagtgttaaaatagaagaatatgaatgatgaagacacaatttttcaagcagtccaagaaagacaaatatctcgcaaaggaatagactgagaccgacaggaacagtgaagaaagggagttaaaaatatctataaatgcagattatagtcctcattcatcaaagagacaaggagacctcggcagttcatattctgaccccttgggctggtgacctgaaatatatttggctgagtgttctcatttgtaaaccgaattcaatttgcagagatttttttttttttttttggaaatagagtctcgctctgtcgccaggctggaattcagtggcgcgatctcagctcactgcaacctccgcctcctgggttcaagcaattctcctgccttagcctcccgagtagctgggactaaaggcacacacaaccaagcccagctaatgtttgtatttttagtagagatggggtttcaccatgttggccagtctggcagagatttgagagaggtaactttaaaaattagagtcatataaagtgtaggttcaagaaatcttaggtccctataaattctctgacaaatctccaatctagcacagttatttactctctgaaattctggtaacaaagacaagcacagattacttttgcctgattcaatcatgtttcagacacaaagtcatctaaaatgcaaatatagtagtctgatagttcattatgtaaaattaacataaagagttgccgtttaaggaaatatgcaaatgttacctcttatgaacttcctgcttgataactgagtctgatgtgcatgaaggtgtggtgctcctagaaagatatggcttcagtgcaattgtccatcacacaagagagctgatagaagaaggcacagctttattggaaagaagaccacagaggagcctctagtggcttccatgacatcctctccgcccacctctgatttcagccttgctgctgtggacggtgccagttcccattcacctcttgctgacagtgcccttctgcagtgcctgcttggaatgttgctgcttcctgctctggggtcttctctggtatctgaatccacttgggctgtattcaaagacagccagaggtcctgatgctcctggtggaacaggacagggggacaaaagctccaacctgcccattcatgcagatactccagagagcaccctatgctcttggaggtcctgatggattccgtctcctgttgccccagcacaaatacaatattgcacctttatcctggtttctcccttccctattttgttttccttgctctcttacttcttcctggaatcatttcccaaataagctacatgcacccaagtctccccatcacagactttgtcttcagagacagactaaactgtggcagtgatggaatgaagcgaccatcaaaagaccctaccttttgaaggagacaactgtttatcttttattcatatggctacccattcatttaaaaagtcttatgatgatgtatataaactaatcttttccaaatccatttggattcatctggaattcccagcgttctcaggatggctctctgctcccttaaaacttcaaacctattttgaactgaataaacttggattctgtttacagaagtagaatctgcctggactcagataatcattcattcctttcttcattcaataaatatttaatgaattataggtgaagattagattcaagttttgtggcgcacaaagctgatacattttaggtagctctttgcaaaagagagtgcaaaatagcaaagagttgaaaagaccctgtgcaagtgagaaggcctgaggttattcttcatcggcttcatggcaaatacacaggtactgtccaggtacttgggaaacaccagtgcaaaaaacagacaaagcttcaagttgaggtagacaattttaacacataattgttataatttattatacttaataataaattaatttaaaagtagaaggatatattcctggtagatgcttatctccccggagaagttagagtgtcattgagaatatcaacattcttggtaaatcatacctgatttagggaatgatccttggagctctggaattctacatgccttaccttgcaaaatgaaggtcctgatctgaaaagttttttttttttttttttttttttttatgccctggcccaaccatgaggattggcttctttgctgtgtggctcttggtctcccaggatcaggtgagttctgggcatagatgagaaagtccttcctgggcttgtcgggccccaaccacggcctcctatgggggtgctcatgggcctcctccctgtctccacttctgattctgtgtcctctctcactggagcatgattgtgggaattacccatccaggttgcatcaagatgtgcaatagatagcctattgtatctgaaataactattgcagtgttatggactacatgtgagttttgcaccatagcacgtttacaaatccatcaaccttctcccatttggtgaatataagatctgctggatgggaatagaggattttcctgtgaccctagagactccaggtaggtgtagttcttggtgaacatttcatccatattcctaatgagcctcctcttttcttcacaggaagtacagtcactcaggggacttagatggggcagtgtttgtggcttcacctgaagcaaagggagaaaacacccccatgagaatacacagcagcctgagcttggatggtgacattcccatcaggtgtaatgaggtgctacagcatgtaacaagtcttcaagcggtcatgaccttgaacctggaacttggaacttggagacatttctggatgtcatttaaccgagggtatccctgtatgctggcatacaagtgtccagaggttaaacgaagaggaaaataattcaacttggagttgaattttgtgcaggaagtcataaaagtcaccaggactgctatgacaatgttctttagcctacagaaatattcataaaagtgaaaatagtattcaaataaagaatttctcatgatggaaataaaatatacatagaagaacaaattcccctattaaaatcagggaaagagcttaggagtttattagatttctttcaaaacagacctaaaaattattcaactctgttataaataatttgttcctgcggggaagagaaggggcatggcaggttagctccgcagttcaagcattcagcaggaacagtgacatcatcaagtcactgagagcccaacttcagtctgcccacagcagggctgggagacacaagatcctgccctggagctgaaatgggcacgaggctcttcttctatgtggccctttgtctgctgtgggcaggtgagggctggtcacaggagggcctccttccctggaattcccaaggcctcagtgcaggcttttctgttgggatgacagcatcagcatctgttgttctctattacaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgagtccacagtgctgcacagctgcctcctctctgcacataaagggcagttagaatgactgaggttgcctgtgctcccaagtcccagccttcacaggagtcggagagccctggctagcctgggggccatagagcaggggccatataaaccttgatgttgaggtccattcctaccccagtctcagaccaactggaggtcaccccaacacccttagcttctgcagttccctctttccttttgtaaaatggaaaaggcatctttagtcgagattcctaatttcgttgaaaatttgaaacccaccatattcttctctaccctaagggctgggtgacttttccacataccctttcccctaccctctactgcctttcaactcccaatcataaatctttgcccatgtggtctctgctcctgggggccctttattctaagggcaatagacccacgaggtcctatatcattagccatttacgtacctcttcatcatcattttgcaccatgttttccctggctctctgctccagccacactcccttacatgcagttatttcttcatatgtgtctgttgttttccaccctggggattgtttatataaattctttcttctgcactgagcatacataccacccacttagtcctacatctctacttcatttcttaaattaaagtgtatttcaggcacacttgctcttaattgtaaaaagcaaaaaagaaagtttactagaaaaatttaagaaaagcattttatgcattcagttgagggatgacatttttagaggagacaaaaagccacaagccaaaagaacaacattcataacgctagttgcattaaattgtttcaagccaaaacacaccataaaaaataaagttaagctacagcctgggaaaggcatgaggaatgcatacaaatgatgaaaaatcagtgtgacagagaacattcagtgtaacagagaacattcagaacatcactgaatacctgtagctcctccatggtttctggtctcccttgcagttggaggggtgggaacatgtcaccaggttctgaatagtgggataaaatgatgtcagctcatttcaagcctggcccttaaaaatattctgtggcaccatgttgagggtctctaaatgtactcccatgtttagagtgttggtatatggcatagagttgtactcatggctaagatttattaaagtgtcatagtaaatactctgcagcagaacatgtggagaaaacacacaggcagaatctggaggaattcacaggcaggcttccttatgctctcttcctctcaggaggggtcacacagagctctctctcctcccagcagcaaaaatgcattaacacacgtgcagtgtatctgccaagggagcccattacagacttagcacccaagaggttttagtagaagctggtcacacaggcacctactttttagcatgaaccaaaagtctagatcccaaaagaaaatctgatgttcagcataatattatttgcaacaccagcctaggaacgatgagccacccctgtcagtcaggagaaactttgcatcagttcagggcaccgttcaccagccaagctcccagatgtctgccagagtccaatcttgcaagcaggactttctaagcaccgcagtctccagcctcctgtcaactcttgtgcacagacactcttcaactctcttttgccatgtcctgaactcgggagctacacggtacagattgcctaatgataatatggaagcagcctggctcactgagtcagaatttggtggacaatcacagaagaaagctgctcatgccacactgggctttgtggtcatgggaagtaagacttcatagagctatgccagtgagattttaggatttgttttgtttgttttgttttctgtagcacagctgttcttgtctaagagaattagtatctagaatgagtaaaatattcttattacttagtattaagaagacagctcaataaaaatagcaatactgaggctgagtaggcaattcacacaagagtgaacataagttaccactaaacatgagaataacttcgcaaccttacttacaatcagaatattgcaacctgaaacagtaagttatgatttcaaaattactagattggatacttttccaaggaatgacagtcctacatttgagtagacatatgggctggtgaaaattgtttgtatatttattacaaaagataattacaactacatcagaaaacccactgtgggatatattgtgacaaaccacatttctggaaaatttatcaacgtatttaaatcacttgggttcctttcattgtctttaagttcaataatggagaatgcaactgtcagtgtttttcctattttgaaggtagtctttccatcttttaaaaagtatgataaaatgcacgtaacatataatttcatcactttattttttaaatgtacaattcaatgacattaagtacattcaccttgttgtggaattatcagcattatccatttccaaaattattttcatcaccccaaacagaaaccctgtacccattaagaaataacttcacattctccctcctctggcaaactctaatctattttgtatatgaacgaatttgcctattttagataatgaatttacatgaaaccaggcactatttttccttttgtttctggcttctttcacttagcataacgctttccaggtgtatccacattgtagcatttattagaacttcattctttttcattctcaataatattccattgtgtgtatataacacatttgtttattcattcattagtcaattgacatttgggtggtttccaccttgtagatattgagaacaatggtgcagtcaagactggcctggaaatatctgtttgattccttgttttcaattcttttgggtctatacctaggagtggaacttctgggtcctttggtaattctgtttctcgttttgagtaactaccaaaatatttctttgttgcagctgcacgattttggatttccaccagcagtgtccagtttcttcacaacatttccagaacttgttatttccttttctttttcttttttcttttcaaaaatatgatgatgatgattactgtttttatagccatcctagtaagtgtgaatgatatctcattgcggttttgatttgcatttccctaatgactaaagatgttaagtgtcttttcttgtgcctatgggcaatttgcataccttctttgaaggtaatatttattttatttgattgtgtttttagagtcgctattgactttagatttaagctggtgtacctgtgatgatactaaaggaaattgagattgagattaaacttctcttgggcgatttgttgttggctaagtgtttttaggtgcagtacttctgagacattttgggatactgtagagagagaaataagtaatttattgatatttctgggaattagattttttttacaaagagaagagagatataaataagaaacgggaagatgaggaagaaatctgtggtgctgacttgaattggagttattaatgcaaacttaaggttttaaagattatatatttcctaactttatccagagaagggtctaaaaaacaatacaaagtaaataaacgaatggctatatttgcttttttttgtgctccccagtaacaataggtacattattttattccaaatgttattccttataaaaggctgcttccatatcaagggaaggaaaagtgttagaacatcttttggtagaaatcaagaaaaaggtcagaaccaagaagacatgtccaaaatccacagaagcaatttcaaggggctccattagccaaatccgggtcaatgcaagctttaaagaagaataatgaggatactgaattgtaacaagttataaaaatctataaggctataatgacaatcaaaagagatagataagaatctcttcattacggaagaatgctagttgatatatctaatgagaaaatcaatgcaaccatccacataattatagacaaattccattagtagatgcctaaactaacagtttttgtttccttcaatactttgagttatactgttctactctctcctggcctgttgggtttctgctgagaaatctgctgaaggccatactggggctcctttaaatgtgatatgtttctcactgcatgctgcttttagtattctttctttgtctttgatttttggtaatttgattatattgtgtcttggtgaactcctttttgggttgaatttgattggcagcctccaagcttcctgcacctggatgttgctgtctttcctcagatttgggaaattttcaaccattatttccttatatatgtttttggggcctaacagcatatgtaccttgtttcaaagcatcaatacacagattattacttaattacaaagggtaaagggcacattcacaatggagagatcttggatcagtcatctcaaattaagcattgccaaaatgcataaaaatgacattccatattcttgtgattgaccagatgcaatgggaaatagacatcatctatggtgtatattttccaagtaattaacctctaataatatgaaaatttttatcgtgagctgttttacaagtaagctgaccaggacacttcaaaaatctatggtcatgaaaaacagaaaatataataagtgggtggaggagatgtatcattgaaaagtaactaaagagatccgacaacttcctgaaatacatgatctttgatattgtcccagaggaaaaagtaaatcaaaaccaagggacatggttttggtggggacaaaccacggccaaaccgcaggcggggctctggcaagacagtaggaatagatggagttgggaggaactccccccagtgccgcgcaaacactgtccaatattagccctgattctactgaggacagtgtagacatggccccagtatttctgacccatgaatggagggcctgagcctggtaactctgaaccattcattgaccagcaggcggcactagggtttgctggggttggcttgcttttaaatcagggctcagtgctgtctgaggagttaagtttaaaggaaaagtgtgacttcatcccagcatccagaatctagtttgcagatgtttgagtgtcctgtggaatgtgagccattaaacagaaactcttcatcttccagcaatgccagtatcctctgttcagcagggaaaccccaactgtagcaaatcattgagtgaataatgttctgggcttgcatcagggatagatggaggagagccaggagccagcctgcatgctcacagacccatataaagggagaaccacttcctcctcaggagaactcagagaaaccttagcaattcacctgtaccccacacctaacccattccagttgtgccctggatggtggacaggaggatgtaaagggaacataggagaggggagtggacaattccagacctctccagataggcttagctcaaataaccttgcaaatattctgaataagagccagatttcccagggctctggccttttcttccctgagcagcatgatgatgctccattcctgtcttgacaaggattctgtcatggatttcttggttgtgctgcccaggaagcaggtgaggcccaggaacaatgaggaatgtcgtccctggacttggcatgcctcactcgcaagcacaccatatgtgggtcctgtgattgataggtttgatagatggatacgtcctgtttccagccaccagcctctatcccctgaatgctgttgtcaactcagagccacaactctggtcacaaagatggagcaggtagtggcaccttaatgtgaagaaagtttccatcatgcaattgttacctggtgcctacatgagttagactcaaaccagcagctgtttacctcagtgatagaggatttatgacagaaacagagggctcttgtaattctatacccacaggtattcacctgataaccttcacatgtgtcccctaggttttggggactttgagcctgcctcactgaacacatatatcctcgttcccagctctctggacatgcatctccttgtattattgtcttatgccaactctcaggtgcttcatcccctaactcttcccatcctttaccccttaggcaatgaataaaagtatatttgtgactaatgttgccccattagaaaaaaaatgccagatactagccactgctgttcaattgtaacttatactaaatctgtaaggtttttttttttttaagatttcaacaaatctgattttagatttcttttttcttttgttttgttttttgagacggagtcttgctctgtcgcccaggctggagtgcagtggcgcgatctcggctcactgcaagctccacctcccgggttcacgccattctcctgcctcagtctccagagtagctgggactataggcatgtgccgccatgcccggctaattttttgtatttttagtagagacggggtttcaccgtgttacccaggatggtctcgatctcctgacctcgtgatccacccaccttggcctcccaaagtgctgggactacaggcgtgagccaccatacccggccgattttggatctcttactgtattcacaatgatattttcagggataagagagtccccacccatcttataagatatcagaactttcattacattgatgaccaagaaccataggcagaaccatgatgaagacttggtacacaatgcatcatgaagcttgataacagaaaagagaaagctggccattgaccttcaccaaaaatgaacccttccaactctctctcagggtattattttacccctttagcttagagcatgtcagctggttcaacatgcttctaggataaacctgtgtcaactaccccagctcccactctgtctaagctcatagcaatgagaaaatggagaacctggtaagacagaaatgcccagagagaaggatatacagataagacatagaggttactaattgttgtctgtattttgagttgcctttgacacattcaagtagaaacatgcagcagaagatggccctggagatgcagtgggtgatccaatcccccaagccctagagatgtgagtaaagacacttggatgaacttacacacagtccatgaatacgctaaagcaacttctagctctgttttagttcataacaactggtttctaagaacttaggcacttgtggagacaatgatgttactgtaggaactaccgtataaggacaggatgtcccacctcctctgctcctgttcacaaggaccctgaactggcaaagctcccatcctgccctgaccctgccatgagcaccaggcttctctgctggatggccctctgtctcctgggggcaggtgtgtcctaagaacaccatgatcatcccattggaaattccagtgatttcttcaatcatttctgtctttctgttttcaaattctgtctttttccccaacagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagcttagccacagcgttgcagagactttctctcctgtgcacaaaactccagggctctctccgctctactcagctcacagcagcctttccttattcctcatcctctcagggaagaagtgagttttcagatatagctagggttcatatagtgggaggaaatgaactattttcttaaaacatgagcgctatagttgttggttgaaaacatgtcttagggatttgaaacacttctgggtgggaattcaagaaaccaaaactgaaagtgatttatcccagacctagtcctcaggggcagtgatggttgttcttctataaaaaatgcacacaatgttgtacgttaattaagaaaataaataaataaacttgaaaaataaaaacatttaatcaccaaaacgtgtgttaaactttaataatatagatattgattacatgcaagtgacaaacagcaggccctccttctgccgttgtcagcatctgaatgatgtgaatcttatctggctctggagcctcttcttgacctctcactggatgtttcatgcagtcaaatctcaacagacactgtgtgtttggaaatcttttccctctgtttttgtggaaatatgacaataataataatattgtaatgatgatgatgttgatcatttcagctatttcattcagcacactttaaacttcaaagaaatgcacacaaatggttatcctggaaacaattcccaaatcttaactcaaaatgaattttgcttctctggagtgctttaacttttcagtgtaacagacacagcccaacactataattaggcctgggccagctagttcagaggctggtgaagacacttccacctgcctgcctacttccttgtctgcccactaaaatagctccttagtgcattagatattcctgccagaacttcagaagcaatgaactgcccctggtccagttgtctcctctgataatgcactgtgtgtgtccaactctagtctctaccctaacttctgcccagattctcctgtactagaactcattctgaagtactggttagaatgtttgggaaggcagcttcctgggaatcctccgaaggaccatggctgtcagtgattccctcgtaacacttcttgagagcatcttgtatttcattgaacgtaggactcccatttatttcagtctgtctgctcctgttcacctctgagatctctgtggcttgtttgtgttgatttccttttgtgctgcttcttggtcatttgttcgtatttttccttataaacctgattatttttgacatcgtgccagacactatggttgtagaaataatttttggtctaggatggacatatctttctccagagataattttattgtgttttgtaaagtgcatggatacataaacaatccaggactccctgaaaaagaattaaaggcttgaggtgtcctggagcccctggagaacaggtttcctactagttccttgtttcaattcaagttcctcagtggtcaccctcagtaagttctggtcttagccattaccccccagcctgtgaatcagcttcctgagagctgggctgggatcagcaaatgcccctaagggcagtgactgctgtgttcactcccccaggctcctgccttctccaagattctggaccagttgtccctcataatgtttttgggatattaattagtttcagtttttgttagtgtggtaatttacccaactatttaaataataacagaagggttaattttgttacaagaaaggggtcctgatccaaccgccaagagagggttcttggatctcatgcaagaaagaattcagggtgattccacagtgaaaagccaaagcaagtttattaagaaagtaacatggtgaaagaacagctactccacagacagagtagggctttcccaaaagtaacaggaggagcgcatctaccctacgtacaatacttgtttatatataggataagaaaagatcgttgagagatgtgctctgctacaagggtttgtgataaaggattaactttcttaattactatgttttgcaagaatcagtattattatctttaaagagaaattaggaatgtttctgttctcaagatattggggtatcatgacactcccaagtctgggtctgtttagtaaacattattaatctgttgctttaaccataaacatctagaggttagggatacctgattttctgggaatgcagcccagcaaggcccagcctcattttttcacttaagatggagtcactctggtttgaacgcctctgacaatttgagtttcctcttctgtaattactcagatgaaggtcaaagaatttcatttaaagttttaattttctttgaatttcaatgtctgattcttagtctgtgatttgcttgatatttaacttaaatagcatagagaaatgttttactaaaactttaatttcgaggaaaggacttttttaaaaacttgaaggggatttataatcaaattgggacactcacttggttttgacattttatcatttagagtattattatgttgttaattacataaccttcgatgcttcattcgaacagggtaatgagaatagagagtaaatatttaaacttcatcagatctttgacacacctgacaaaaacaagcaatggggaaaggattccctatttaataaatggtgctgggaaaactggctagctatatgcggaaaactgaaactggaccctttcgttacaccttacacaaaaattaactcaagatggattaaatacttaaaagtaagacctaaaaccataaaaaccctagaagaaaacctaggcaataccattcaggacatagacatgggcaaagacttcatgactaaaacaccaaaagcaattgcaacaaaagccaaaatggacaaatgggatctaattaaactgaagagcttctgcacagcaaaagaaactatcatcagagtgaacaggcaacctacagaatgggagaaaatttttgcaatctatccatctgacaaagggctaatatccagaatctacaaggaacttaaacaaatttacaagaaaaaacaaagaaccccataaaaagggggcgaaggatatgaacagacgcttctcaaaggaagacatttatgctgccaacaaacatatgaaaaaaagctcatcatcactggtcattagagaaaggcaaatcaaaatcacaattagataccatcctatgccagttagaatggcgatcattaaaaagtcaggaaacaacagatgctggagaggatgtggagaaataggaacgcttttacactgatggtgggagtgtaaattagttcaaccattgtggaagacagtgcgacgattcctcagggacctagaaccagaaataccatttgacccagcaatcccattactgggtgtatatacccaaaagattataaatcattctactataaagacacatgcacatgtatgtttattgcagcactcttcacaatagcaaagactcgaaaccaacccaaatgcctatcaatgatagcctggataaaggaaatatggtacatatacaccatggaatactatgcagccataaaaaagaatgagttcatgtcctttgcagggacatggatgaagctggaaatcatcactctcagcaaactaacacaggagcagaaaaccaaacaccgcatgttctcattcatacggaggagctgaacaatgagagcatatgggcacagggaggggaacatcacacaccagggcctgttggggcgggggggtcaaggggagggatagcataaggagaaatacctaatgcagatgacgggttgatgggtgcagcaaaccaccatggcacatgtatacctatataacaaacctgcatgttctgcacacgtatcccagaacttaaagtataataaaaataaataaataaaataaagttgatcagagagcagagagtgaacatggaatttacttcattcctgcactgtcgtgactcatttgtgccatgttttgtgagcacacctgaggggcaggggtcagaattggagggagtcacaggtgtgtggctatcatcttttccttcccagtcccctggaaaggtgcttggttccacattttccatttgggggaacttccctaaagtgatacactggtttttgtctattatttgccaaatgtttcttatgggaagtgaaataagttatcttatttagtctcctcttcatctgaggttagtctctcttcatcatcatcctttcatcctggctactgagaaaaaaaagtagattcttttggtgctttttcaacatacactaagatcagtggagaactttctttccttacagggttggcctgtagtttgcaggggagagagaatggattaaattctgatacagaatagtgtgggttggcctatttgctctcctatctgagcactattagttattaacactgatattttatctccacttgtctgacttcaatgtccacctctcaggtggttccatcttaggccatagcaacattaagattgctttctgaccttctaacaccaacaaatcataattcccatatctccatgactcaacaaagcaaagcacaagtcccctgtgtcctggcaagagagcagatttgtgctgtttctgcctactggccacaaggaggcactgtggctttgttgtcatcagagtcaaatggggaggggcgaagatggctctctggaagattcttaagggaaaccctgggtttggccctagattcagggagctgggctgtctggaatgaaggctgggaatgaaggaattagagaccaaccaatttgcctgtattgttgtggagaagggttttgctctaaactgagctctgaatggggctgagtggcaggtgtgcttgcagtggatatatgtctgagcgcccttaagatgtggaggcacaagtagctggggtggtgcagtgcccaggttctgggctgggaaagcagagaagcagttttcatgttacaggagccttggagagcctggccccaaacccccaaaccagctcaggccagccctacctgctctgttaaaagtagaaggaagagcagggagagacggaggtgctaccctggaccatcggagggaccctgttccccagtgagggggcaatcacaattacaacaccagtagcatatacacttattaggcagacactagggtggagtagaacagagttttctccaccaagaccttttgctctcagcaggaaaatggcccagtctattaatagttcacctctgctactcacttcagactcctgtgtgtcccctggaagaaggtggggtctgggtagagatagtatcttttcttttggtttgaattaaagttctttccatatgactcgttcatttgcctctacctgtatcttgtatctagcttctgcctcttgtattcatgtgtgccttggacactataaagtatttgatttctactgctgctgtaatgaattaccactgattttggaggtttaaacaaaatacatttgctaccctacaatactggaggccaggagtccaaaatcagtgtaactgggccaaaatcaaggtgttggcaggcctgcgttctttcccagagctctaggggagaactgtttttctccccttttcagcttctagaggctaccagcgtgtcttggcttgttaccccattcaatcttcgaaaccaacagggactgactgagcctttgctcatgctgcatcactctgacactctttgtcctccctcttccacattttaggacccttgtgactacattggacccgcctggaaaatccaggacactctcccagtatgaaggtcagctgattgacaacctgactttgtgtggaactttaatttttcttttacaagtaacttaacacattcctaggttccagagattagacctggacgtggttggagggcctttgttctgcctaccaaacctaggaacttggtaagagggaggaaaacaaaatgatcacctggaaaccagaatactgaccaccgttttacatcccaggcctaacagacacaaaaagggatggagcccacaaggaaatagacacctcaggtctcacaagctcgtctgtaaactatttgctccttaggatcggaaagtactctggggtgcaggggactcagcagtatgcctctgtgccagcagcaaaaatgtggccctaaactgctccttcttggttagcaattaacccagttgaccaacccacagagcagaggcttctctcagctctgtacactctacaccctgagaggaagtcggcttctgagatgcaagactcttttataaggaaaagtccagttgtaaagattaagaaactttgagctttgctagaggtaaaaataggatgtaagtcaactctggagcatttaatttccaaatgtttatgaaaaagacaatcttcttcctgttttattgtatggatagagaatgagagagattctgtactctgggctttgcaaactcactagagttcaagaataaatacactcagagaggtctttcactgcaaagaagagctttgaaatcgaatgaactttcaggatatcagttcggctcctgtatctctaacaacgcagttgacatgcttgcccttcctagggatctcaggggccaactcctaactcacttgtggataattgaagtgcattcaaaggagtaggagcacagagacatcagggagaggaataggagagtttgcagagaatctggcttgctgtaagacaatgagttcatcttgaaataattggagtgtgaggtgcagatgaatatagttggcaagatcctaggtaagatatactatagagaaggctttatgaattggtaatatcaagacaaatccacagagagcctccgtaggtgtgcatttgtgtctcagatcaattatagttcagtcctgcctgattcatctcccagagatgcagcctccacttaaataaggagctttcaaattggaggtggtggcccattcagtgacgtcactgacagatgcatcttgtgtggataaaatgtcacaaaattaatttctttgttcatgctcacagaggccctggtctggaatgttccacttctgctctcactctgccatgggctcttggaccctctgtgtgtccctttatatcctggtagcgagtgagttctccgatatttattatggtcatgctggacctctgtctagatgactccttatattttccttattctttcccccaattctgtcttcttttatagcacacacagatgctggtgttatccagtcacccaggcacaaagtgacagagatgggacaatcagtaactctgagatgcgaaccaatttcaggccacaatgatcttctctggtacagacagacctttgtgcagggactggaattgctgaattacttctgcagctggaccctcgtagatgactcaggagtgtccaaggattgattctcagcacagatgcctgatgtatcattctccactctgaggatccagcccatggaacccagggacttgggcctatatttctgtgccagcagctttgccacagcactgcagaatctccccatctctgtgcagaaaccctggtgcttcctcttctccccacagctctcagcagtcgtcagcaaagtctttcctgctctctgctcaccatggctcacgcctataatcccagcactttgggaggccgaggtgggtggatcatgaagtcaggagatcgagaccatcctggctaacacagtgaaaccccgtctccactaaaaatacaaaaaattagccgggcacggtggcaagcgcctgtagtcccagctactcgagaggctgaggcaggagaatggcgtgaacccgggaggcggagcttgcagtaagccgagatcgtgccactgcacttcagcctgggcaacagagcaagactccatctcaaaaataaaataaaataaaaattaagtgggtttggagaatgacaaagacagaagatggtaggatattaacataaaaaaaatcatgtgtaggggataatgtagaaaatgtgttttgtgaatttctcacaaattgtctaaggagtcagaattcacaggcatgtaagataaaccttaattacccccactgtaggtttccttgtctccaggtatttgccatccgcattagcaagctgagagctcctgagaatggctatgtcttttgaactagtctgccctctgcattctattttcaccctaagctgtgaacagaaatttcccccacaagttttcttgattgtaaaagaaagttcttttctatggcattccttataatgttaatttcaacttaccatttatatagggattttgcattgcacttaaagagtaaacctcctgtgggtaatacaggcagtgaaataggttagatgtaagctgctcctcctggactctagggatctatttgtctttatcctgcttaaggagagccaagttctagctgaaggcctgtgccaactcacaggacactgacgtggtctcttccactgcctgcttggagctatccacatgtatccacacaggctgtctaaaagcacacaggcctggccagtcttactttgacctctttcctccctgatgctgtgtcctggacacgcatatctatatattttttctggtttatgccgcgtatttctacacagcacttgcaattcattctgaagaattataatttctttcttctatagtagtacttacatactgatcacttctcaacccctatcagggtatcattggcaggtgttgcaaactattcctgtattttgagtgcccaagacaatttgagtttacctgagttcttccatataggcctaggtttcacttgtcattgtctagttttgttatttaaaggccaaggttttcaagatcacaacagtacagaataaaattcaggaattttttaaaatgtacatcaaccgacctactctgtgtttatctattgtcctggtgtctcccttgctctttgggcttctctttgctgcctccagatcactttctttcctccttttttgaagcccagctccttacatacatgacgttagaacaggacccttcattgctgcacttgcttttttcccttcagaactctcttcccattcagtcctgtctgctactaatcctgtcatcattcttaacgactactcatcccacagaccatttttacattggtttggctcctcacttttgaggattttttttaacctactttttttttaagaattgcttccatgattacagtaaatatctactgaataaatgcatgtcttcctcagcttggagatttctgagggttgcaactttgtcgaatattttatccattaatcctaactgtgtatattagacaaggaaggtattaaaaatcatgttttaaatcagaaaatcaataaatagatttaaagagacaaatgcaaaacaaaactgtttagagctgctgttctgggctgaactacagatggactgtgtaagaaatagtaaaatcatctggtaatttcaacttatctttagaatctttggccggaacagctccagggaatcaagggatcataggtggaaagaaagacaaagaggttaaggaagtgagaactggctagggtagcattctctaccttaaggttttcaaacataatatcaaggtcctcagtttatttgtaatttttttgaggatgaaaggaaattatgcacgtgacccaaggtatacacaataaggaaactgacacatgactttgctgagatggaattatattaaagttctgtgacactcacaaactcatctcatgctgattagaaactgtgattggcaatgctgtgtgttacaaaaaaattaaaaaatgattcctttaaaaacattatttctttaaatcagcattttccaaaaatgggggaaatattaaatactatccaattttggtggtgcaaaaaataaaaaagcttaggggcttccagtacccctgacccagctgaccttcctttcccaggcccatgtcttttaatgtgcatttactcagggaaagggaagtgtggctgtgcaggaaaagtggcaatttagaaaacacaggctcaagggcttgatggagggtcccagaagagggcagggcactggtgatcagaggggattagagggcaagctgctagggtaagctgtgcatcagaagtggttccttttgtttccttcagcagtaaatttttattatcattattactttagctgtcctccatatctacttctttagtatggctggctacttctctttccaactctttatgcactaccgtggatctcaccctaggcagaaacaaatccccaaactctcaccagctgcgctcatgaaacaacccttcctggcaggctgtgatctcgccaagagcgatcaagttgatcaagctataaactgacttcatcactagtctaaagaggaaactgtggcaagaacagctgcaggagaaaccctaattacaatgggaggagagacataaggattttaaagcagttttcaaactagtccttctcaagaaccaaacatataagggatcactgggagctgtctctgaagtgggttaaagagaaaagaacagacaaagataaggttctgatgcctgctctctgttcctacagatctctccagaagtcactgtagacctgctacaatttccctcactttgctgtgacacagcctttcttcgttggttcctcctccctatgacttaaacctctctccctcccctcccctatctccattcttccagaaaattcctctgccattcccagagacttgcagaacactggggtttgaaatacattaaatagattttttttaattaataatgatctctgttaagtaacaaaagtttcatatgtgaattgtgcacaaaaaaattatagtaaacttctgagataatgttagaaggcttatgtaatgatcaggctagctttgatgaaggaatttgggactcagggtgagaagacaagataagttagtagacaataaaatgagttgatttattctgtagtagttgggaacttgtttaaaaaaatggagaaagaaattgttgaaaaccctaactccctcaagaggtctgggaatcctgtagcttacatggaatagaaactgaaagggaatcgcttgaacccaggaggcggaggttgcggtgagcagagaacatgccattccactccagcttgggtgacaagagcgaaactacatctcaaaaaaaaagcatgatcaaatttgaatcatagccaaatcttacaaaaattttatgtgaaatatttaattttgccaaaaaaaaaattgatgcaatgacctctacccttgttcacctttttttatcttcactatgtcacagagagtttggcacataatagatgataagtaaatttattttgactctattgagtaaatgacaataatatttcacattctctcaatataatagttgaattctatgtgtactttcttacttagcagagtttcacttcaaaaggggcttcgtcctccacatgaaatacaacagagagtcattatggctagtctcaattttccatacaacttctgcaatattccaagcaaatgtgtttccccagtcaggattaatgaccaatgttacacagtatcctaaccacatctaaagctggaatttgcaaacatccttttggaacaaagaaatttatgttataatagtatttatccagtctcatgatctggtaaaataaattcttcaccacaaccacattttcccaaaaccacattttttgaggctggaaacatcatcatctcagaaagcaccctaaaacactgtaagaaaaattcaccgtgctcggtaatagaatcttatcatccttgcaataagaagataccgtgtgtatgagtgcgagtgtgagagtgtgcatgtgtttatatgtgtgagtgtgtacacgtgtgtgtgtgcattttctcatggagactcatccacatgaaaatagtttctctttggatttcattactaagaggcactgggtgattggtggagctcataggcagttctggggagtgacaggaaatgtcagaccactcaatctgcctaagttatagctgatagggttgtttatttcaagactttctataaattaagaattaaatatgaaaaagcccagagacctccattataaaatgcactatctaaaattctgtaaataatccaagtacaaaatatgaagagatatgtgtctgatcaatcaaaaggagacatggaatatcgcgtttccaggctggatctgtttgatctcttcaagctgttttactttatgccctgtgttattcagggttctctctttcatcttatcatatgaattgcaattatgtaacatttatcagcaatcaaaatattggttaatgcacccttttgtctccactggctaagggtggatttgaagatcaaccctaaattggcctgcttgggaaagcattgaggttgtgtgtgtgagagggtagggtttgtaggagcggagatgcgggaatccctgttcctgatttggacaatcttgagcacatcagttcagaaagtgtgaatccatgagactctggacagttggccacgtggaggcactgtggcttcacaatgcagtggggaaccttggagagcggtgggagggtgacccaggagaggagggctgaagggaagcctggttgtctgctggcatcagcagggcaatctgagttcagagtggatcctgagttaaatactgccagagaagggtaggggtgccaaaggcctcaatttgccccaaggaaaaagtgtctctgtgtctgtatggacagtggagggtgctgaggctggggtgtcaagggctggggaatgcttctcaggacagggacagggtgggcaggcataggaaaataggggttgttgtgagcatgtgggcactgtgctgcacctgccccacctttcgtttaggggccctgcagaccaggaatggaacatggaatagcagagcctgaggcctgcctaagtatgcagtgagctcacagtgtcctgcagggccagtaactggaaaggccagtttcctatggaaatgccagaaatattcctgccctgactgaggttcaggatctggtggcagcctttcccaggcactctctgctgcttctttttttttttttttgagggcatcttgctttgctctgtcaccaaggctggagtacagtggcttgatctcagctcactgcagcctctgcctcctgggttcaaatgattctcctgtctcggcctcctaagtagctgggattacaggcacccaccacaacgcctggctaattttttgtatttttaataaagatggggtttcgccatgttggccaggctggtctcaaactcttgacttcaaacaatctgcctgcctcggcctcccaaagtgctgggattacaagtgtgagccactgtgcccggcccctctgctgcttctttatgtgacctgttttaattctgacagaaatcattcaaaataagtattatcttacctgtttatacatttgactgaagcagctttcctgggtctcacatacgcttagatggaagaaaccagacctggcattggatagatcagtagtagtgtgacagtagttaacatcagccaattatgcatttcaaaatagtgagaagagaataattcaaatgttcctagtctaaagaaaagataaatatttaagataatgcctatcccaatgaccatgatttgattatacaaatgtatcaatgatcatatctacctaaaaaatatgtacatctaatatacatcaataaatagtgaattaaaaaaaagataactggccgaagcctgttcctccaacacctctatccactgttcccactctgtagatttgtcctctcacctggccttccgtttccaggtccccattagcaggaggggaagattatgccacatatgtgatcattatagcctctccactgacaagtccaaggaggatatgacttccaggcaaaacatcttttcatctttcattgtgacaaaaatcaaggttcagttttctccactatagcagttctatgggtgaggccatgtgattgcttttatggaggctgtgtgaggagggaggtttctcagctgcacagcaaggaaataagatgttgtttaaggaaagcacagtcttccagtacctgatgcaatttaccatgagggaaaagacacaaataattgctattcattagttaattttattattttttaataagacacaaagtcatctaaaatgcaaagatagtagtctgataattaggtaaaactaacataaatggttgtgtcttaagggaaagtaaaaatgttgccccttacagcacttcctggttgatactgagtctgatatgcaagaaggtgtgatgctcccagaaagctgtgaattcagagcaatcagcaatcccacaaaagagctgatagaagaatgggcggttttattagaaagaagaggagcctctagtgccttccacgacatcctcactgcccacctctgatttcaggcttgctgtagtggacagttgtgtgcaagtccccattcgcctcgatctggcagtgcccttccacaggtgcatgctgggagtctctctgcttcttccccagggctgttccatgatattatctgagcccacctggcctgtactcaaagacagccagagctcctgatgcccctgctgagacagaggactaatgctccagcctgcccattcatgcagaaacttcagacagcattctgtgtgctcctgagaggccctgatggattccatctcctattgctccaacacaaactcttttgttgtttgtgcacttttatcctggcttcttccttccctattttatgtttcgttcctacttcttcttcctggaatcatttcccgaataagctacatgcacctaagtccccatcacagactttctcttcagggatagcctatactgtggcagtgatgggatgaagccaccatccaaagacccttccctttgaaggagacctttgtttttcttttactcataccgctacccattcgtttaaaaagtcttatgatgacatatataaactaatctcttccagattcatttggaattattcctgaattctcagcagcctcaggatggctctctgttcccttaaagctctgaacccaatttgaactgaatagacttgggttctctttacagaagcagagtttgcctggacccaggtaatcattcattccatttttcttccattcaacaaatctttaatgagctataggtgcagagtagattcaaattttgtggggcacaaagctgatacaattttaaggagctccttgcaaagaagaatgcaaaatgacaaagtgttggaaaggtcctgtgtgagtgagaaggcccgaggttattcttcattgatttcatggcaactacataggtactgtccaggtacttgggaaacaccagtggagaaaccagacagagcttcaagttgaggtagacacttccaaaaaattgttataacttattatactgaataataattaaaaagtaaaaggatatattccccatagatgcttatgtctccagagaagttagagtgctgttgaaagtactgacattctgggtagctcacacctcatttagggaaggatccttagagctctgggattctacgtgccgtatcccaaaaatgaaagtcctgcactgaaaagatttttttttcccctgccctggcccaaccacgaagattggcccctttgcttggtctcccaggaccagatgagttctgggcatagatgggaaagtccttccttggcttaccaggccccagccacggcctcccatggggatgctcatgggcctcctccctgtctccacttctgattctgtgtcctctctcactggagcatgattgtgggaattacccatccaggttgcatcaagatatgcaatagataatctattgtatctgaaataacaatagcagtgctattgactggatgtaagtttggtgccaaagcacgtttacacctcctccaatcttctcccatttagtgaatacaagatcttctgaatggaaatagaacatttccctgtgaccctagagactccagatagttgtagttctgggtgaacatttcatccacattcttaatgagcctcctcttttcttcataggaagtacagtcacttatgggacttaggtggtgagtgtttgtggcttcacctgaagcaaagggaaaaatcatcctcatgagaacacaccgcagcctgagcttggatggtgaggctcccatcaggtgcaatgaggtgctacagtgtgaaacaagacttcaaatgttaaagaccttgaatccacaactttgaaacctttctggatgtcagttgactcttttaaccaagggtatctctgtaggctgaaatacaaatatccagaggttaaacaaagtggaaaataattcaacttggagttgaattttgtacagagaagtcataaaagtcaccaggactgctatgacaatgctctttagactacagaaatattcataaatgttaaaacagcattcaaatgaagaatttagcataatgggagtaaaatacgcatagaagaacaaattcccctattaaaatcagggaatgagattacacattttaagatttctttcaaaacagatctacaaatttttcccaatctaagcttctcaagtatgtctataataaatgatttgttcctgtggggaagagaacagatgtggcaggttagctctgaggttcaagcatttagcagggacagtgacatcatcaagtcactgagagctcaacttcaatttgcccacagcagggctgggagacacaagatcctgccctggagctgaaatgggcaccaggctcttcttctatgtggccctttgtctgctgtgggcaggtgagggctggtcacaggagggcctccttccctggaattcccaaggactcaatgcaagcttttctgttgggatgacagcatcagtgtctgttgttctctattacaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgagtccacagtgctgcacagctgcctcctctctgcacggaaacggcagttagaaaaactgaggttgcctgtgcacccaagtctgggccccaccctgggacgtctcagcccccataggagtcacagagtcctgcccaggttgggggggtgtcttagagcaggggccatatgaccctcagtgctgtggctctattcctacccctgtctcagaccatctggagtttgccccaacacactaaccttgctgggtctttcttctgcagctctctttttctgcttgcagaatggaagagatattttgttgatattcctaattcccttcataatttcaaagccaacatattcttctctcccttatgggatcagtgacttcttcgtgtaaaccttaccgtatcctctactacccttcaactcacagacacaaatcttcccccatgtggtctctgctcctggctgcctttcttctaagggcaatagccctacaaggtcatctatcatttgcccttcacctgcttctccatcatcattttgtttttttttttttttttttttgagacggagtcttgctctgttgcccaggctggagtgcagtggcgcgatctcggctcactgcaagcccgcctcccgggttcgcgccattctcctgcctcagcctcccaagtagctgggactacaggtgcctgccacggcgcccggctaattttttgtatttttagtagagatggggtttcacggtgttagccaggatggtctcgatctcctgacctcgttattcacccgccttggcctcccaaagtgctgggattacaggcgtgagccactgcgcccagcctccatcatcattttgcattaagtttcccctggctttctgctttagccacactcccctacattcagtttacacgttcgcaggtgtagtgttgttttccaccctggggattgtttatgaataatagattatttctacttcactgagcatatgtgcctccaacttattcccaggcctccacttcattccttacataaaagtctatttcaggtacatttactcttaactgtaaaaagcaagacaaattttatgagagaaaaattaagaaatatatttttagcactcatttgaggaattagttttttagatgacacataagaaaaccactagccataaaaatatttgaggccgggcgcggtggctcatgcctgtaatcccagcactttgggaggctgaggcaggcggatcacttgaggttgggagttcaagatcagcctgaccaacatggagaaaccccgtctttactaaaaatagaaaattagctgggcatggggtgcatgcctgtaatcccacctactcaggaggctgaggcaggagaatcgcttgaacctgggaggcggaggttgctgtgagccgagatcatgccgctgcactccagcctgggcaacaagagcagaactccacctcaaaaaaaaaaaaaatttgtaactccagttgcattaaactaaacttttgtacaccaaaacatagcataagaaatgaaatgttaagccacagcacaggaaaaaaatgaggaatgcatgcagatgatgaaaaatcagtgtgacagagaagagtcaggctcacccatggctcctctatgcttcctggcctcatttgcacttggagggctgggagcatgtcaccaggttctgaatagtgggaggtgagtaaaaataatgttagcccaatttcaagtctggcccttaaaaatatcctgtaggtccatgctgagggtccctaagcgtactcccgtgtttagagatgtggtatatggcatagagttgtactcacagctaagattttctaacatgtcttagtaagttgtcagcagcagatcatatggagaaaacacaggtggaatctgaaggaatccaaactcaggcctccttatgctgtcttcctcccggggaggtcacacagggttctcgcttcactccgtagcaaaaatgcattaacacatgtgcagtgtttctaccaagtgagtccaacagagactcagcactcatgaggtttcagaggaggctggtcacaagcacatactgcctagcattaaccaaaaattcagactccagaaggaaatctggtgttcagtacaatactgtttgcaacaccagtttaggcacaacgagccgctcctctcagttaggagaaactttgccagtgcagggcatcactcatcagccaagtggccaaagatcagccaaagttcaatcttgcaagcaggcagtctcaagcctgctgtcaactcttttctgcacagacactcttcaactctcttttgccatgtgtggatgaatttgggaggtcatggcacagattataaactggaagcagcttggctccctgggtcataatttggtggacagccatggaaaaaaagctgctcatgccccactgggttttgtggtcatgagaggtaagacttgatagagttcagccactgagattttaggatttgttttatttatttttttttctgtagcataggtgtccttttctaataaacttagtacataaatgagtaaaacattcttattaataagacgacagcccaataaaaatggcaatactgaagctaaataggcaattcacacaagtgaacataagttaccactaaacatgagaataacttttcaaccttacttataatcagaatatagcaacctgaaataataagttatgattcaaaaattactagataggaaacttttcaaaggagtgacagtcctaaatctgaatagacatttgaactaatgaaaaccgtttatatatccactagaagagataatgacaaccacatcagaaaacccactgtgggatatattgtgactaatagcatttcttgagaaattatgagtgtatataaatcatttgggttccttttcttgtctttaggttcaatcgtagaaaattcaactttaagtatttatttttcctattgtaaaggtagttttttaaaacaatcttttaaaaaagtgggctgggcatggtggctcacacttgtaatcccagctactcaggaggctaaggcaggagaatcgcttgaacccagaggcacaggctgcaatgaaccaagattatgtcactgcactccagcctgggcgacagagtgagactccatttcaaaaaaaaagggtgggtggcagggggaaatatgtgtaacatataattttgtcactttatttttaaattgtacaattcagcagcattaagtacattcactatgttgggaaactgtcaccattatctgtttccaattttcttttcattgcctcaaacagaaactcaatacccactaaagaataactccacataccccctctttctgctaacctctaatctaatttctttctgaatgaatttgcctattgcagattatttatgtgaaaccatgcactatttttccttttgtgtcttgtatctttcacttagcttaatgctttcaaggtgcattcatattgtagcatttatcaaaacttcattccttttcatttctcaataatattttgttgtatgcatataccacatttgtttatccattcattaattgattaacatttgggttgtttctaccttgtagatattgggaataatggtgcaatgaatattggcctgaaaatatctgtttgatgccctgttttcaattcttttgggtatatacccaggagtgaaacttctgggtcctttggtaattctatgtttctccttttaagtaactaccaaaatggtttttttttggttgcagctgcacaattttagattcctaccagcaatgtcatttcttcacagaattgccagcatttatttcttgtttttcttttcaaaaatattatgatgatgatgattactattttgtatagccatcctagtcagtgtgaatgatatctcattgtggttgtgatttgcatttctctaatgactaaaaatgttaagtgccttttcttatgcctatgatcaatttgcacaccttctttggaggtaatgttttttgtctgattggcttttttggggtgtctcttgactttagaattatgttggtgtactgcgacaatgctaaaagaaattgagtttgaacttcatttgggaggtttgtggttggtagtgtttttagtgcggtacttcttaaacatttttaatataccatagaagagagaaaatgattacattttgatatgatttggctgtgtcccaacccaaatctcatcttgaattgtatctctcacaattcccacgtgttgtgggaggaaccctgtggggaggtgattgaattatgggggccgggtctttcctgctgtctcgtgatactaaatgagtctcttttagatctgatggttttaaaatgggattttccctgcacaagctctctcttttatgttaccatccaagtaagacatgacttgcccctccttgccttctgccatgattgtgaggcctccccagccatgtggaactgtaagtccattaagcctctttttcttctcagtctctggtatgtctttatcagcagcatgaaaatgaactaatacatatcgtgatttagggaactcctttttggattgaatttaactggcaacctctgagctttctgtacctggatattgctaactttttccagatttaaggaattttcaaccatgttttatatatgcttttgggactggaacaggatatggacatttttccaatgcatcactccacagattactactcagttacagagggtaaaagacatattaaaaatgaagagatccagtgtcagttacctcaaatatacattgacaaaactgcataaaaatgacattccacattcttgcaattgaccagatacaataggaaatacacatcatctgtggtgtatatttgccaagtaactaacctctaatagtatagaaattcttgttgtggctcattttacaactaagctgacctaggcacttcaaaaacttataatcatgaaaaacaggaaatataataagtgggtggaagagatgtataatttaaaagtaactaaggagaactgctaacctcatgaaatacgtgatctttgattttgttctagaggaaaagtgaatcaaaaccaagggacatgctgagacaactggagaaatttgaatgtgaagtatgtactagatgacaatgctatgtgaatgctaatgttttgagcgtaatagtgacatttgtggttatataagataatgccaattttttaggagactcattttattattaaggataaaatgcttcagaaattgagggcaaaatatatatagagagatcaagcaaaatcacaaaatgtacaatcggcacacagatatacattttaatattctgattgtttcattattctctcaccttttccatagatgttcagtttaaaaaaattgaagaaaaatattaacagaccaaaataaaatgttggtgttatttcagagtaataatgttgttgggtatttcttatattcatttttaatatatttgaaatactatgtcattaccataaaataaatatatcaaataaggtatcttttagtctagagtatacttttttaaataggagacaggctatgatttttaagaaagtcccaaaagaaaacaagagaatttgcagtctgaggacaaagcagcttggtatctctgagaccagtgcaaaacttagctagtaatgcatgtcaagaggccttttagcaaatatacaggactgttttctctgtatcaagagattctgagtattctacagtttggctgaaaactcaagaactttcaaaggtgactgaatgtaaagagaagagtagtgattttccaaagttagggctggacaatatgtatttgttcaacaaagagggaggctgtctcagtttatcctctgctgctatagcagaatacctgaggctgggaaaatgtataaagaaatttataaggaaaagggctttatttggcttgcaattctggaggctggaaagaccagtagggcatcaacatctactgaacttcttttgagggctttgtgctgtgtcacaacgtggaagagaagtgggagaaatgagcaggcctgtgcaaggagagccaggatgagcaagaccctcactttataacagcctgcttttatggtaactaatccagatgctggagagagagaactgactcctggcattaatctttgatgagggatctactcccatgacccaaacaattcccataaggctcacactaccccagaaaaatgtgagcaatgtgcctgtagcaacaccactacattgacgaataagcttcaacatgaattttggtgggaacacaccataactaaactataggacaggctctagcaagacagtaagaacaggtggaactaggaaaaaattttccctggtttctcacaaacactgtcctatattagccctgattctattgaagatagtatagaagtcccaccagtatctctaagccatggaccgaggacctaagtccagtgacactggccatcagaaggcactggggtttgatgatgctcaaatgtttttgaaacagggctcagtgctgcctgagatgttaagtttaaaggaaaagtgtgtatcctagtatccagtatcttgtttgcagaagttgtgagtagtcagtgaaatgtgaaatattaaaaaaaaaaaccctttatctttcattggtgctggcatgttctgctcagcagtaaaatctgaactgtagcaaatcttttgagtggagactcttctgggcttgcatgggaggtagatggaggaggaccaggagccagcctaaatgctcagagacccatgcaaagggaaaatgactggctcctcaggagaattcagagaaatgtgagcaatgcacctgtacctcacaccttacctattctagtcgtgctctggacaatgtatacgatgatgtaagggaaatataggagagtggacaattctagtttatgccagataggctattccaaattgcaggtagtaactacagatattcttaacaaaaaccggatttcccagggctctggccttttcttccctgagcagcacaatgaccagttcctgccttgacaagaattctgtcatagatttctcagttgcgctgcccaggaagcagatgaggcctgggaacaatgaggaatgtcttccctggacttgacatgcctcacttgcaagcacaccacatgcaggtcctgtggactgataggcttgatagacagataagtcctgtttccagctaccagcctccatcccctgaatgctgttgtcacccagaactgtaaacctggtcacaaagatggagcaggtagtggccccttaatgtgaagaaattttccatcatgcaattattacctggtgcctacatgagttggactcaaaccagcagatttttacctcagtagtaaaggatttatgacagaaacggatggctctggtaattctatacccacaggtattcacctgataaccttgacatgtgtcccctaggttttgcaggtttggtggaatatctctgagtgcacctcactgaacacatatatcctcattcccacctccctggacgtgcatctccttgtgttattgtcttatgccaactctgaggagcgccatcccctaactccttttatttcttattactcaggcaaggaataaaagtgcgtttgtgactaatgttgccccattagaaacaaaaaatagataatgaccactactgttcaactgtaatttacactagaggtatagctataaggttatttttagatttcagcaagtctctttgattttgcatttcttacaatatatactgatattttcagggataagagaattccccacctatcttcgataaaaatgagaacttactttcattgcactggtgacccaaaactacaggcagagccatgatgaaggcttggtacacaatgtatcatgaatgataacagtaaagaggaaactgttcattggccttcactaaaaatgaacccttccaactctgtgcccaggttattgttttatccctttagcttacagcgcgtcagctaattcaacaagcttctaggataaacttgtgtcaattaccccagcttctaagtgcataggaccaggaagatagagaacctagtaaaagagaaacacccaaagagaaggataattgctgataagacaaagaggtcactaactgatatctctgtttcgagttgccttcaactcgaaacatccagcagaggatgggcctagagatggagtaggagatccagtccccaagccctagagatgtgagtgaggacacttggctgaacttacacagtctgtgaatacagtaaagcaacttcgtgctctcttttagcttataataattggtttctaacaatgtaggcatttgtggaggcaatgatgtcactgtgggaactgccatgagaggacagggacgtccctcctcctctgcttttgctcacagtgaccctgattgggcaaagctcccatccttccctgaccctgccatgggcaccaggctcctctgctgggcggccctctgtctcctgggagcaggtgagtcctaggaacaccatgatcacattggatctctctgattatttcaatcatttccttctattttcaaattctgtctttttccttctcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagcttagacacagtgtagcagagacacttccctcctgtgcagaaaaccagaaaaccgcaggactctctcctctctactcagctcacagcagcctttccttattcctcatcctcccaaggaagaagtgagttttcagatatagctaggactcatatagtgggaggaaataaactttttcttttcttttctttttttctttttgtttttgagatggagtcttgctccattgcccaggctggagtgcagtggtgcgatctgggctcactgcagtctctgcctcctgagttcaagtgattgtcctgcctcagcctccccagtagctgggatgacaggcatgtgccaccatgcccagctaatttctgtatttttagtagagacgggattttgatatgttggccaggctgatttcgaactcctgacctcaagtgattcgcccttctcggcatctcaaagcgctggaattacaagcttgagccactgtgcctggctggagataaactatttcttaaaacatgaaggctgcagttgttatttgaaaatatgtctaaggaatctgaaacacctatcggtgagaattcaagaaaccaaaactgaaagtgacttatcacagacttagtcttctggggtactaatagttgttcttgtatttaaaaaatgcatacaatattttatatcaattaaaaaatacgtaaatttgaaaaataaaaacatgcagtcaataaacatgtgtgataaactttaataatacagataatgattgtatgtgagtaacaatcagcaggttttctctctgcagttgtcagcatatgaataatttgaatcctatccttggtgacaccctggctctggagcctcctctagacctctcattggatgtattatgcaaccaaatctcaacaggtactatgtgtttggaaatctttttcccctgtttttgcagaaatatgctaataagagtaatgttaaagatgatgatgttgataatttcaactatttcattcggcaccctttaaatttcaaaaaaatgcacacaaatggatatcctggcaacgagtccaaaatcttagctcaaaatgaattctgctactccagagctttctaactcttccatgtaacaaacatatcccaacattatatggggctgggccagctagttcagagactgatgaggacactttcacttgtctgtcctcatatattaaaatagctccttagttgatatggtttgactgtgtccccacccaaatctcaacttgaattgtacctcccagaattcccacgtgttgtgggagggacccgggggatataattgaaccatgggggccagtctttcccatgctattctcatgatagtgaacaagtctcacgagatctcatgggcttatcaggggtttccacatttgcttcttcctcattttctcttgccgccaccatgtaagatgtgccttttgcttcctgccatgattctgaggcctccccagccatgtggaactgtaagtccaactaaacgtctttttcttccctgtcttgggtatgtctttatcagcagcatgaaaacagactaatacatcagtgcattagatattcctgaaagaacttcagaagcaattaactgcccctggtccagttgcctcctctgataatgcattgtgtgtgtccaactctagtctctaccctatcttctgcccagactgtcttgtactagaaattattctgaagtattggttagaatgtttggaaatgcagcttcctgggaatcttctgaaggactgtcactgtccctcagcccctcctgacttccctttccatccacctgactgcaggtcctaactgatggccatgaactcactacacatctcccttccttccctgcaatttactcagctaacaacacctcagccaggtggtgggtgaccatgaccatcctcctcttccttgccagaattttcatttggttctttttctgatctataaggtcatcttttacagtcagtcattccctcataaccttttttgagtgtatcttttatttcgttgagcataggacactcagttatttcagtctgtctgcttattttcacctctgtggtctttgtggacatttttgtatgtgtgctgcttctcagtcatttgtttgtatttttccttttaaacctgattatttttgacatcatgccagacactatggctgtagaaataatttctggtctaggatggatatatctttctccagagataattttattgtgctttgtaaagtgcatggatgcataaacaatccaggactccctggaacagaattaaaggcttgaggtgtcctggagaccctggaggacaggcttccttctagtgcattgattctattcaagtccctcaatggtcacattaagtaagttatggtctttgcctttacccctctggactgtgagtcagcttccttagtgctgggctgggatcagcaaatgcccataagggcagtgactgctgtgctcactcccgaggcccctgccttctccaagattctggcccagttattcctcatcgtatctttaggatatgaattagttgcagtttgttagtgtggttattttactcaagtacataaataataacaaaagcattaatctgagttccctcttctgtaattatacagattaaggtcaaaacattttatctgaagttttaattttctttgaattttaacgtcagattcttagtctgatttgtttgatatttgacttaaacagcgtagagatgttatacagaaactttaattttaaggaaagaactttttaaaaacttgaagtggatttataatcaaattgggacccttacttggttttgaggttttatcatttgagtatttttatgttatttattacataatctttgatgcttcactggatcataagacaagatgagaacagagagtgaatatttagacttgatcagagagcacaaagtgaacatggaattagtttctgttgatgaacagtccaactatgtaaaatatttaaagacatttattctgagccaaatatgagtgaccatggcctgtgaaacagccttctggaggtactgagatcagtgcccaaggtggtcagggtgcagcttggttttctacattttagggagacatgagacttgagacttcaatcaaacacaattaagagatacattgtttttggccagaaaggcagacacctggaggcaggagtggggagaggttccagcttaaaggtagatataaaatttttctggttgacaattggttgtctctcaggttaaattttaaaagagccctggctgggtaggaagtccattcagattattgggggccttttaattttatttgtggtttacacttcatttctgcattgttgtgatccatttgtgccatgttttttgagtacacctgagggccaggggtcagaactagagggagtcacagatgtgtgactatcatcttttcctacttaagcccaggcttctgggaaaacactttgctccacattttccatttgagggaacttgcctaaagcaatgctccagttttattctttctattgcttgccaaatcttccctatgggaagggaaataagttattttatttagtctcctcttcatctgaggttcctctctcttcattctctccctttcatcctggctactgggaataaaagcagattcttttggtgcttttttaaatgcactaagatcagtgggaaactttcttttccttatagggatggcctgtaatttggaggggagagagaatggattaaattctgattcaagacagtgttggtcggtctttttgccctcccatctgagccgggttgtttatggatattaaaactgatattatgtctccatctgtcagactgtaatgtccatctctcaggtggttccatcttaggtcataatgttgttttatgaccctccaacaccacaaattatggtatctcgtttccccatggctcaataaagggaagtgcaagtccttggtcttgacaaagagcacatttgtgctgttcctgcctactggccaccaggaggcactgtggcttcactgtcatccaaagtctatgggggaggggctgggattgctccctggaggatccttaatgaaaaccctggagttggacctagagtcagggagctgggttggaggtacctgcaatgaaggctgaaaataaagggattagagaccaacccttttgcctcttgatgcggagatgggttttgctgtaaattgagatttgaatagggctctgagtggcagatgggcttgcaagtggatgtaggtctgagctcactgaagacgtggaggcacaaggagctggggtggtgcggcgccgtgttctgggctggggaaagcagaaaagcagtgtttgtgtcacaggagccttgtagagcctggccccaagccggccgaggctagccctacctgttccgtcgaacgtagagggaagaacaggtagaaatggaggcgctaccctggaccatgtcagggggagcctgtcctcaggcagcttcaatcacaatgatgtaccagcagcatatacacttattagcaaggcttagggtggagtaggacagaattttctcccccaagaacctttgctcagggcgggaaaatgctgcagtctagttctaactctattactccagatgcctctgtgtccctggaagaaggtggggtctgggcatataaaagttttgtttgttttgcctgggttgatttcgtttttccatgtgatcgtgcatctgactctaccagtattttgtatccggcttctgcctctctctctcatgagtcccatggctactataaggtattcaatttctattgctgctgtaacgaattaccactaacttggtggcttacaaccacacaagtattaccttacagttctggaggtcagaagtccaaaatggatgttactgggctaaaatccaagcgttggcagggctgcattccttcctgaggctctagggaagaactgtttttctctccttttcagcttctagaggccaccagtgctccttggctcatggccccattcaatcttcaaagccagcaaggactggctgagactttgctcactctgcatactctgatgctcacttttcatcctccctcttccacattttaggaccattgtgattacattgggcccctatattaaggtcagctgattggcaagctcacttcacttggaacattaattcccctttatcaggtaatttaacacattccagggattaggcctgggcatggttgaaggggcattgttctgactaccaaacctaggcacctggtaatagggaggaaaacgtgttggtcaccttaaaaactgattgatgactaccgttttacattctggatctaacacacacaacaaagggatggaacccacaaggaaacagacacctcaggtcacacaagctcatctgtaaactatttgctccttaggatgggcaagtcccctggggcgcaggggactcagctgtatgcctctgtgccaacagcgaaaatgtggccttaaactgctccttcttctttgttagcaaataacctagttgaccaattcatagagcagaggttctctcagttctctatactctacaccccgagaggaagtcagttagtgagatgtaagattcttttataagaaaaagaccaggtgtaaagattaagaaatgctgagctttgctagaggtaagaataagatgtaaatcaactctggaacatttaatttccaaatctttgtgagaaagacaatcttgtttctgatttattgtgtggatagagaatgtgagagattctgtgctctgggctttgcaaactcaatagagttcaaggatcaataaactcggagagacccttcactgcaaagaagagctttgaaatctaatgagctttcgggacactgattcagctcctgtatctttaacaacgcggttgacatgcttgctcttcctgggtaactcagatgctaacttctaactcatttaaaggcatttgaagaactaggagcacagagtcaccagtgagaggaagaggagagtttgcagagaagctggcttgcaataaggcaatgagttcatctttaaatacttggagtttgaggtgcagatggatatagttggcaggctcctaggtaaggcatgttatggagaaggtgctatgaattgataatatcaaagcaaatctacagggatcctctgcaagtgtgcatctgtatctcagatcaattatagttgacttcagtcctgcctgattcatctcccaaaaatgtagtctgcctgattcatctcccaaaaatgtagcctccgcttaaaggagctttcaagttgggggtggtgggccattcagtgttgtcactaacagatgcatcttgtgggggtaaaatgtcccaaagtatcttttcttgcttatgttcataagggcgctggtctggaatgtgccacatctgttctcactctgccatggactcctggaccctctgtgtgtccctttgtatcctggtagcgagtgagtcctcatgtatttatcatcctcatgctgggcctctgtatagatgacttcctgtattttccttattctgtttcctaattttgcgttcttttatagcatgcacagatgctggcattatccagtcacccaagcatgaggtgacagaaatgggacaaacagtgactctgagatgtgagccaatttttggccacaatttccttttctggtacagagataccttcgtgcagggactggaattgctgagttacttccggagctgatctattatagataatgcaggtatgcccacagagcgattctcagctgagaggcctgatggatcattctctactctgaagatccagcctgcagagcagggggactcggccgtgtatgtctgtgcaagtcgcttagccacagcgctgcagaatctccccctccctgtgcagaaactctggtgcttcctcttttcctcacagctcccagcagtcctgagcaaagtctttcctgcctcaccctccccacaagaataattaagtgggtttggggcatggcaaagacataagatgatacaatatcaacatacaaaatcttgtgtaggagataatgtcgaaaatgcattttgcaaatttctcacaaattgtgtatggggtcataactcacacacaggtaggataaaccttaattacccacaccgtaggtttccctgccttcctgtatttgacactcccatccaaacagtgggagctcttcagaatggctatgtcttgtgaactactctgcccacttcattcccttctcactctaagccatgaacagaaatttcccctacaagtactctttattgtaaatgaaagttcttttctatgattgtggacattcctttataatgctaatttcaatttaccatttatatacggatttttacattaaacttaaagagatcttcagtgtggataatacaggcagtttaatacattagaagtaagctacccctcttggcctacagggatccatttgtttctatcttgcataaagcaagccaggtgctagctaaaggtctgtgtgcactcacaggacactgatgagatctcctccactgcctgttctggaactatcaatatgaatatacacagggtgtctaaaagcacacagggcctggtgtggtggctcatgcctgtaatctcagcactttgggaggctgaggcgggaggaatgcttgaggtggggagttcaagactaggctgggaaacagtgagattttgtctctaaaatatatatatattttaaaaattagcctggtatggcagtcttagctactcaggaggctgagttgagagggttgcttgagccctgaagttcgaggctggagtgagccatgatcatcgcaacagagtaagaccccaaatcacacacaaaaaataaataaataaagttaaaaaacatacacaggcctggccagtcttacttggccctctttcctccctgatgctgtgtcctgaacagccaaatctgtattttttttcttctggtttatgatacacatttctacacagcacttgcaatttattatgaagagttataatgtctttcttctatagtagtatttacatactgatgatttctcaacccctatcagtgtatcatcggcaattgttgcaaaatgtgcctgtattttgcatgcccaagacaatttgggtttacccgagttcttcgatagaggccctggtttcgcttgtcactgtcctatttttgttattcaaagactgagactttcaagatcagaatgatgcagaatgaaattcggggtatcctttaatgtacatcgagagacctactctgtgtttatatattgttttggtgtcttccttgctctttgggcttctctctgttgcctccagatcattttccttcctcctttgaagcccagctcctttacacacatgacattagaacagcacccttctttgctgcacttgcttctttcccttcagaactctcttctcattcagtccttctgtctgctactaatcttgtcatcattcctaatggctactcatcacacagaccatttttcattggttttgcttctcactttcttgacttcctcacttttgacattttatccattaatcctaacattgtatatctgacaaggaagatattaaaaatcacatgttttgaatcagtgaatcaataaacaggtttaaagagacaaatgcaaaacaaaattgtccagagctgctgttctgggctggactacagatagatcatgtaagaaataataaaatcatctggtaatttcaatttatctttagaatctttggacagaacagctccaggggagtcaagggatcatagatggtaagagagacaaagaggttaggaggtgagaactggctagggtggcagtccctaacctaaggttttcaaggataatatcaaggtcctcaatttcttttaaatattttttgaaagtgaaaggaaattatgcacatgacccaagctatacataataaggaaattgactcatgtctttgctgagatggaattatattaaagttctgtgaaattaacttatgggctcatctcatgctgattaaaaaccctgattgacagcgctgtgtgttacaaaaatgacaaaataaatgattactttaaaaacattattttaaaaaattagcatttgccaagagtgggggtaaaaaatgacatactgccagatggtacaaggaatggagacgtttgaggcttccagagcctctgacctagctcaccccactttcccgggcccgatgtcttctaaagttcatctgtgcagggaaagggaagtgtagttgtgcaggaaatacggcaggttaggaaatcacaggctctagagcttttacaggcttttacatcctgtgtatctgtgctatttccacagtctgcaacaaactgtattctccccaaacagggccagacactcctcatctatcaaggactgactcacatctaccttcctctttgcttcttaccctgacattccctggccactgcagtatatcattctgtttcctttacattcagaggaaaattcaggtatataattgatactactcgatgtttgtgaaatgaataaattaatgtccatttatacagagctctgaaatattatctattactgttttcccttcaaaaggggctccttttacttgaaatatgatggagagtcattatggctagtctcaattttccatacaatttctgcagtattccaagcaaatgtgttttcccagtcaggattaatgaccagtactacccagtaccctaactatatctaaagctggaattcacaaatgtccttttggaacaaagaaatttatgttataataatatttatccagtcctatgatccagtaaaagaaattcctcaccacaaccacacttttccaaaatcacatctttatgagtctggacacattatcaggggtgcatttcagaagtcaacctaaaacactgagagaaaaatttgttgtgctcagtaatagaatcttatccttgcaataagaagataccatgtgtgtatgtgtgtgtgtgtgagtgtatatgtgtgtatgagtgtgtgtgtgagagtgtatgtgtgagtgtgtatgagtgtgtgtgtatgtgcattttctcatgcagattcatccacatgaaaaagtttatctttggatcgcattacaaagaggcactgggtcacctggggagctcataggcacttctggctagtgatgggaaatgtcacaccactcaatctgcctaagttatagccaatagggttgtttatttcaagactttttataaattcagaattaaatatgtaaaaactagaagccccttttattaaatgcactatttaaaatttggtaataatgactctaaatacaaaatatgaagacacatgagatattaaatatttttccaagatcattctgctggatagcttcacactgtttaattgtatgtcctgtcttattcaggctcctctcttccaccttatcatatgaattgcaatgacataacaacgattaattttgcaatcaaaatgttggttaatacactcttttgtctccactggctaagggaggatttagagattaaccctaaattggcttatctgggaaagcttagagagggtgtatgtgagagggtgggggctgcaggagcgggatgcaggggtctctgttacggatttggacaatctagagctcatcagatcagaaggtgtgaatctgtgagactatggatctatagccacttggaggcgctgtgtctccgcaatgctgctgggaaccctggggaggggagggcaggtgacccagaagaggaaggctgaagagaatgcctggctgcctgctagcatcaggtgggggccatttgagttcagagtgagttctgagtttaacacagactcctcactgtccagagaagggtaggggtgcgaaaggcctcagtttgtaccaacaagagagtgtctctgtgtctgtctggccagtggatggtgaaggggctggggcatccagggcttgggaatcagtgtcagggcagggacagcggtgggtggagtaaggtgtgacatggacatgtggacactgtgctccacctttagtttcgggacccttcagggcaggaatgatacatggggtagcagagccaggcacccacctaagggtacagtgggcaaaggatggcctgcagaggaagtaaatagaaaggcaagtttcctatggtaatgccaaaacattcctgcccccactcagaaaaagaccatgaatgggatgttggcagccagaggggctcaggatctggtgatccgacaggcctttcccaggtaccctctgttgcttctttatgagacctgttttgattctaacagaaatcatgcaaaataagtattatttaactgtgtatacacttgactgaaataactttcctgggtcttgtacactcttagatggaagaaaccagacctggcgttggatagatcagtaatagggtgactgtagttaacatcaaccaattatgcatttcaaaatagctagaagagaataattcaaatgttcttaaggtaaagaaaagacaaatattaaagtgatgcctatcccaatgaccatgatttgattatattaatgtatcaaagatcacatctactaaaaaatatgtacatctaatatgtatcaataaatagttaattgaaaagaagataactagctgacgtctgttcctccagcacctctacctgctgtccccactctgcagatttgtcctctcacatggccttccctttccaggtccccattagcaggaggagaaagtcaggcattatatgtgatcactatactctctttgctgaaaagtccaaggaacatataacttccaggctaaacatattcattcatccttcattgtgacaaaaaagagaggtgcaattttctgcaccatagctgtcctatgaatgaggccaggtgatctctttcatgaaggatatgtgaggagagagatttctcagtgcacagcaaagggaatgggatgtttttaaaggaaagtgtagttttcctgtacctgatgtaatttattatgagggaaaagacacaaatcattattattcattagttaatttattgatttcataaacattttaagccccctgctttgtacaagggattgtgccacataaatttaaaagcgaaacaaaaaataaaatttagaaaaacagataagacaatttttaaaaacagtatgtttctcgcctttgacaatattaaggcaattaatatggaaatgtatttattgaattattttgaaatttatattttgctaattcaaaatactttaatgtttctgaattatacaaatgtcctttttaaaaatctttctctttagttacctacctccttttaccacctttttaaaaaaaattttagtgagaacatttaatatgagatctatcctcttaacaggcttttaagtatatagtagagtatcgtagtccacagacacaaggctgtacagtagatctctagaacttcctcatcctgcttaactgggaattttatacctgttgacagcaactccccattgccaccaatccctagcccttggaaaccaatgtttcagtttttacttccatgagtttgactatttaggttgcctcataaaagtagaaaaaggcacggtggctcacgcctgtaatcccagtactttgggaggccgaggtgggcacatcacgtgaggtcaggagttggagaccagcctggccaacatggtgaaaccctgcatctactaaaaatacaaaaattagctgggcacggtggcaggcgcctgtaatcccagctactcaggaggctgaggcaggaaaatcatttgaaaacgggaggtggaggttgcagcgagccgatattgtgccattgcactccagcctggtcaacaaggcgaaactccatctcaaaaaaaaaaaaaaaaaaaaaaaaagagtcgtgcagtatttgtctttctgtgtctggcttactcagttaccataatgtcctccaggtttatccacattgccacatatggtgagattttcttcttttttgatattatttccttgtgtgtatataacacatttaaggtctgtggtaataaatgcatagtatttgactgtttctataaaaccacacatcacacgagtaacagggtcatttgcagaggtgcaggctctgagtacattaatgcacctttatggttcaattatgctgcacggagaagattcagaaaaaaaaatcataattccatcctttattgtcattttactatacacaaaatagaagcccttcatttgcaaaattgcagttaattagaaattcaactgtcagaaaaagccttaagacacaaatgctattctcattttacagagaggagggaattgacccacaggttaaataacatgatcacattaaatggctattaggatgcagtaccgggggtccagctctgacctgtcagtctctaagccctgtgtttatagctctgtgctataaggcattttcatgaagagagacgcctacctttcaaaatcagagtatttgctctctacatccctttcagacctgctggctccaataacatcacagacagagatgaatgtatcctggagacagtatggggaaagaactctgaaaagatgccatggcacccagccctgactcccactctaacaccaccacatcactaactgagaccagctcttgacaggttaactttagtttggtttttgttttgttaatctataaaatgagactaatacagtctatctatagggctgtatatagaatttagtatcataaaatatctagcctataataggaatctaaatctcttgattccctttgttaatctcagacagcctcttccaccctcaccatgcacaaaggcagattcagacacactctgcctagaaatcttaagctgagaacttagaagtcacagaagtggaaatatatatacctgatgatccctcacatgaaattaactaaagaatgtagcatacatacctcctcagatagttaaaaatcaacttcattaatatatagattatataaacattacacattttaagtgaactgatgagtgattttggagcaatatatgtgtatagacccttcaatccccatccctattaagatgccgaacatttccatcacacagagagtgttctcattcctctctgcaatgcctccctccatccctgacaaccagtgatatttatcactagaaaattgttttgctcaggtacatttttaatggaaatttacaacctctaactattaaaacacttcctctttagtacacaggtaaatattcaagagagggaggtgctcccaaagatatttatggctattcccctcaatgacagaatggataaagaaaatgtgacacatatacaccatggaatactatgcagtcatatgaaagaatgagatcatgtcctttgcagggacatggatgaagctggaagccattatcctcagcaaactaatacaggaacagaaaaccaaacaccgcatgttttcacctagtgggagttgaacgaagagaacacatggacacagggaggggaacaacacacactggagcctgtcggagggcggagggtgagaggagggagagcattacgatgaatacctaatgcatgcggagcttaaagcctagatgacgggttgatgggtgcagcaaaccaccgtggcacatgtttacctatgtaacaaacctgcacattcttcacatgtatcccgaaacttaaagtaaaatttaaaaaatttaaaaaaagagagattttttatggctttagaagggtttcaaacccttccagaaccctgagagacacctgatccacgttagggataatcctgtctggagatagacaagatgatgaaatgacaccaaaaatcttcccacatggaagaggctatttccacataatttgttcattcattttcattattttttctcatacactcattcacttaaattattttataatgatattctgacaaaaactaatcatctccaagaacattattttgagtttccatcagacaatatttagctgtgattcagctctgcttcctgagcacatagagtgcactggggccaagtgaaccatgtgcaatagtgactaccttgagagataatgtcacattgagagaaggggtctctcttccttgaccgcaagtgtccaacccataaaacatgagccttgagctagaaaattcccctttctgttctggcgctgcctgggcaccaggctcttttgctgtgtgtccctctgttttctggaccagagaaatactgggcacatatgtggcatctactcattggtttgttggaccctagcttgcagataatagtaccaggtgttcctttgctgtgactttaacttctgtgttcttcacaggacacagtcccattgatgggatccaaagtaccattgatactgagtgacccagaccctggtcatgtacttgtgctaaaaaggaaaacagcacatggggaggtgagcagaatatgaaacacaattatggactcagaaacagccatacaacttattagcatcccgttgtttcaaaaaatcataagaatttgaagaacatgacaatgttatactgactgtggcgtcctaataagtgtgggactctgtgcaccaagatatgttatttgaattcctttttattgattactaaattaatggcaggaatcccacacaaagggatactccctatgaaacatgacaactcaaattaaaaaagagcactcttccttactctaaagtctgccctctctccccgagtccctcacgcataaggccacatttgtgcccctaggtcatgggcagcgctggttggccaccatcgtccacatgtagaaggcagtcagcaacgtgaagtggttctgcctactgcagtctcaccccagacatggaaagcaagagccctgggtggagctgaaggtgctcagctgggtttgtcagaagtctcatctgtcagtgagttgacaagaaacagagcaaaacgactcctccaatgttgacgagcctgcccctgggatttggaaacttcataacagaaaaaaccaatatagacaaaggattttaaacaggattaaggtcaattaagcaaattagaaaaggacacttgaaggagtatttgggacaggggaatcaaaagcaccaggaagacatgaggagtttccctaagactctagactacagcactagcactatgtagataactaacactaaaatattaattatatcattgaaaaaataaaatttacagtgaattacaaactgtttccaaaaggtcatgaaaatcttgtagacttgtttcaattcagacagatgtgttcttctcattctcagctgttcactggtgcatttattttggatttgaccatctggggaatgggtgtggcctctcctggcctctccctccctggggcccaggcagggagaatgtctcagaatgacttccttgagagtcctgctcccctttcatcaatgcacagatacagaagacccctccgtcatgcagcatctgccatgagcatcggcctcctgtgctgtgcagccttgtctctcctgtgggcaggtgggtcctgggcagagccccttgtgtgaatttcaaggcccagcgccttcccattggggctgcagcatcagctttgttctccttctctgcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactccacagcgctacaaggccgtctcctctctgcacataaaggcagggaggttctgccctcctcccccacccaagactcagggatgccctgggcagagatctctgcgccaggaaccttggaacccacagtggccccaagtggcctggacagtatgagccttgctctgtgccaggtgcctctgcaggcatctcagccaggcctggactggtcccaggtcctcagatgtctcctttgttgctttctctggtctatccttggagctttccttttggggtggggccagggctttcccagctcctacttttctactcattatcctgagtccgaggcccccaggataaaacaggatttgcatttcagatccatctagactcccgtctctccctggtgaccctgttgcttcctctctctaatgtttcccccagcccccaccctcatgttttctctcctgtggcccacctttcccatctgggcagtcaccctccaaggcgttgctgggtctctcctccccccacctcctcgcccctctctactgcagccatgaggggagcccctgttctgtgcctccttccttcccatcacagagacttcaaaggccatttcctctgcccttgcatggagccttcctttctgcagtagccagctcctacctgtccttcatatctcagcatgatcaacccctcttgtgggaagcgctccctcccctcccatctgaaatcaactttcctctcataagctgtcacagattcatgtgtctgttagtaacctttagcacagcttggctttctcagatacttgtctggttatttttgtactccacccaatttttaagcccatgagagctaaggctgtgcctgctgcatttaccaacattggtgtctggcatgtagggagacccatttcacaaagaatggatgagtgaatgacaggctgagtgagtgatgagtgggtggataaaccaataataaaaacacactacatctactgtaacctggcagagatctagcattaagtacaagaaagcccatccctttgattgctgggctcaggtcggtcttggaaattgatggggaatcactatcatggcggccacacctggctcaaagcttcctcttgtggttgcagagcctgacctcctccaggtctctgtgctctccttcagggtctttccccacaacaaagcgagacagatcagagatccacttctagaattccatccttaaaggttgttccttgaaaccacttctggtaagaaaatctccattaagtttgcaacaaaacagggccgctacaagtttgagagtgtaacaaatttacgatcagaattagactttatgcatatgtgggaggagctgagaaagagaaggtctggaggagagaagtcagaaggcgagggagccagtcaatagccagggctcctgggggtctcggcaggacaggctggattggcagggacatgaaaggatcagagtatgccaggacatgcagtgggaccttgaaccgggggcacaggaaaaggccaaggaaacctgcttctggggaagctgttcccactctacgggggccacccctgcaggtgcactgccaaaacagcagcctggctgctgtttgccagcatttgggaagatgaactagacacagagtgcagaaggaacaagacttcctaggtctgttggatgcctctgtatctgctggtcacagactctcactgtctgaccacaatgacctgccaagtctaatagtgactgcttttcatctgtcttccaaattttaccaaatgtatccttgaccatctctaacccagaatgataagagaaatggcattctgggaaaggcaggctcttgcctttgcaaagctgacttaactcaattcagcccatgatggattcttccagattaaggcatcagatcacacaactgcctcaacctgccatggtccctggactcttctccatggacatctgtgttgcccaggtgaatgtggacacaatttgtatgtggatgttccagacactggctactaacttttcttttaatcctgtacctgaaatctccctccacccagagggtctataaatgtatgagatttattttttaaaaaatagaaatttgaattctattctgaatctttccttgggactggccagagagcatttttgacctactaacctatattgtgggtgtatttggccccccagagtgcagcagacacttcttgggcccatacatttgcgagttagactggagatgcctgtaaacatgacagattcttggtgttgttccctctcagtcccggcctctctggaatgtcgcagactaccatcaaacaaatagatccccagtatgaagtacataaggacacattaggagttagcaatgaggaaatgtgagcacaagcaacaaacgtttgaagtgcaaacccgaagactcaaaattttggcattataagatatgaaagtttggagagctacatttaaatgaacatgagagggaaaaagagaaacaaggaaaaagagaatgtctgaaaccatcaagtaactttcataaaaattgtcaaataatatatctagaaattcctcatacaaccactgaaaacaaaatggaaagtcaaacagttgattagctgctcctatgtcaaagatggatctgcaggagtgatctagaatgcagcacggaaaattaaaagtggaatatgaaaaagttaaagaacagggaagaaaagaaatggatgtttcccatatattagaatatgcaaatttttcataaattaccatttttttttgcatatgattgcagtttcaaatagataaaataggtagaatgttatgaggtgatatttatgagatgttagctgacaattatttagaggtgtttaaggacctaaattcagagtttccagaatcaaaatgaatctcaagtaagacaaatagtcaagtcatagggaaattgtataacatgagggacaaagagaagattttgaaagcagtcagaaagaaaagacagatacctcccataggaatagatggagaacaacagtaagtcaagatagtggttaaaaataaccattagctcaatcgtcattctccttcattagaggtgagattgattaaaaaaaaaacttttatacgtggaatatgaaaaaccaccactgtgagtttgctaccaagttatcttttctgaattacagttaacaaaggtgggaaatgatcccaaagaaaggcatgagggcagttcatgagggaacgcatgtgaggggacagtcctgttgggcacgtgtgactgggggaatggaggaggctggggcatgaatggggatggcagaggggaccctgacttgcaggaaagacaatgagctcacccttttgtgttctatgttaggggcactgttggtgcatcctacaggacatgcctagcagacagaagagcagctgtgggctggcaagatgaactcagagatgcagcgtgaggcctccgggtccagacagatctggagcccaaagcaatgagccatgcattgatgttgttaaaaaggagcttataaatatttaaagcagcacccaaatgtgttctaatagaaatgctggggccctgaggtcctggggattgacagaggaagtgatgtcactgtgggaaccgccctgtggagacaaggacgtcactcatcctctgctcctgctcatagtgacactgacctggtaaaacccccgtcctggcctgaccctgccatgggcaccaggctcctctgctgggtggtcctgggtttcctagggacaggtgagtccttagaacacaaagtagtttcagtttttttctgtgtgtaggcttgtgtgtgtgtgtgcgatgactacaaatattttccttattctgttgccaaattctatttccacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagcttagccacagcgtggcacagtcgcctcctttctgctcacaaacctcatccttctctctccttgcagctcctacaaacccttaacagaggcctctctttgctccttacttttcatgggaaaaaggtagatttggacctcagctgtcctttgggtagaaagagaccgcagattcattcctgaaacacagtgagtgcaaatgtaggtggtgaaaacaatcagagcccactgcgctctgggagtcctccgagccagctcactgttccaagcaaggagtcagtgtcttagccttggccttcagggcagacatgcatcttctataggtcttggaggctgctgtgctgcccacatccatgaggttgtcataggcaggaaacacgcctcttcttcatatgttggggcatttggaaggtctgaggctacatccccaggaacatctttcttcagaagcctgttctacccctgtcaccttggaagtttcttcaacaaaatatcaaacatctcttcctataaagtaaacgtctttgcaaatttgtggtccttattaataaatacaatggtgataacaataagacttcacttcttctgcctactttaagccaggtgtatcctttattttgtttgcatttgccattgctactgtcctgatagacagaagcgtgcattcaccaccgctgcccgttcaccttgattccctcaggaaatctaatttctagactctgagggttttcattgctgtcaaactcatttgatttgaaatcattttcctgaggcctttaactcaagaagtgttttatttataatattgaatatatttctttttcttttatttttcatattatattttattatacagtacttgttataaatagaagtacaatgattatattgtaatagaatcttcaactcgtctgtgggtgctgctgcagtttgtatctatgaaagcgaatgcactggtcagagctgatgtgattatggatcatgggtttcagggagtcttcggcatcagaccacttctccaagtctgggactcagtgtcccagatgcagccatgatagaggtgccctgagtctttcatagctgggaggggcatcatagccctcccaaattctctgatcagaaattgtggtggtacagacaccaaatttctttccccagagaatgatgatctctggtagggagctgctctagacccattttttattgtgccatcatcaaatcattccttgctcaggtaccctctgtctcctgggactgagtaaggccagggcacagatgggaattccttgtcttcctagaccttgtctctaactgctgccaccttcctccatgtgactcctgagacacctactcctaacagtggacaagctctgacactgaggctgaacagaacacagtccacaattgtaaccggtgctgcaacaacatgaaacaaaagcaatcaggacttccaacttatacagaaaatgaacatagaagagtagcaaagggcagatattactaatggacaaataggaaggaatcagtttctgctctaatgaaatcattcagttgtcttgagttaagcaggataaacatttcattgcaattacttcaagtcaaatgtagcagctccacaaccaaccagcatagctatttgctttgtgatcttggcagcttcaaaggactcagaaatcctttctctgcacaaacatccctttgtccattccaagacccaggatcacacactctgatcctatcatgaaaacaatgaggtgtgctatacttgctgcggcctcattttttgtgtgttgagtaggaagcactgaagaactttgaaagctttgctcttgagtctagggatgtgctggagccagcttgtatgagtcagaagaaccaaataggcatattactcttcccagctcccaagcagtgaagccatgttggccacttgaaatctaccatggtgggtatgctggtacaaccgaaattaggaaatgctaccagacatgcccccaccttcacagacaccccagtttatcagcacatccctggggtattttctgatgtccctgttatgccatttcttgtggggccaaaagggctcagaattcacctcccctctacttttgttcttagaagccatcacctaagggggcctcgattgttcctatttctattcaacctccagattctcttgctctgtaattctgtgtctcctgcaagcatgccagtctggaacatgacaactattttgaatgtaactaaaggtatcactgaaccagttcattatttacaaattatctttcctcgcatagaatattcagatgctggagtcattggcaacagagatggccaagtagcaactattcttctgtggcaacgagagaccctgtaaaaaggacaattttgctttggagactaagcacctccacaccagtcaggaatgactctgcttttactttaggctgagaggtcagaagggtcagaatactgagggtcagaggccctcagtattctcctttccaagacggagtatggccactctccatctcagtccctggaaggtgtccggagctccctgagaatccctgctctggggcagaatcaccaaggctcatcctcgccagctccccacaggctccagcagggctttcctgccaggtgcagggcacaggaatggctctatctgtctcttggttagagggaggctatgcaatgatgtttgtataagagggactgggattctgggtctccattaaagtatttgataatattttctttgttttttgttttattttgccatctcaccacttaggagagcaatcccttggtagttatattgtttttgcacttggtaaggtttttgtggttaagtcacattaagaaattgtgcctttttttcctgttcagctgtaacccaaggcagtgaaagaaacagcaataattttgaaagcagttacttatgcatcctatgataaaggtgttaagttccattgcccacatctaactttcagtctagtggaaatgaaaaggcacagttagggggcatgtgagcctgccatgagagaggtcaatgccaattgagaagtctgtgccaatccccagtactgtgggattgaaggggagggagagatgacctctccttcagaccatactcaacaaggagggagagggagttcatccatgggaacctgcggagaagcatatcccaggggcatctaactcagggtgcaggagcaaatcattggaaatgaaaatggtccacttcagctgtcacaggagacaggagaaagaaaagtcatacattccacagtcccctggctgattttcttccttatgatagtattttgcaccagcgtgtcctcatctcccgctgctcctctgcctctttcataatcatctcttccctctttgctgctcagatcagtggatgtgcattgtacaagctgatcatttcctgtagcagcacctttgctggtcttacttatgttcatccttattttgtgcattaggtattgctccctccaccattgcttatttccttgtaagaggtctcctttatatatttcaattttactttttattaatagacatttttaacttcatcttttgcttatctatgcttttggggtaacactgtcatttttggagggcatttttgtttatccttagtcattcagattaaataatctctttatacctcaacgtctgtgttttcttactatttaaaaccaaatattgtttcctttcattcctctccttctgttcctctttctttagatggtagttttaagggagaaaaagttagactataactggagctatgtgataagagttattcagaatgagggtgggatattaagattggtaactcaaagcaatagtcagggttagaagtagtgttgggatgagggtttagggaagctgctcataaaacctgcgggatggcacttctggaatattctggcagctcgctctgtagacatttctcagcagtccttgggccattgcagaagaaacaatgatgaaacttcacttattggccacaagatggcactgtggtccactgggaactaaagtactctgggcagtctgggagagcagcctaggagggaaagggttaagaaaaattcgggcttggatcccatattatgcagatgttgcagcagttttcagttattgctaggctacctacagctatgcaagaggcgggaagtccctctaatctttaatgacatctacagttgaagaatgttggctgggcagctttggtgtcagagcaggtgcagacagaggagcaactgcctcagaggaaaaggcgaaagaaaggggccggctgtgccctgagtccagtccatctctgctgcacttcatcttccctgcatgtctctccaggcaacagctttaacctccttgagtgatcagggattctacaagtttataagtcgtactgataacatcaccttggcttagattccattggataccaagcacgtgttctctggagggccaaaaatattgacaacaatttctaaaacacctaagtaaacaaactacagaaggaaaatattagtagatgcaccaaacagtgccgttagacctgaagataatcaatgagtagaattatcaaaaggagactataaataagtctctactaagtatttgtgggcatcgagcagtgtttgagtcctctcagggtagattaaggaaggaattcagctattatcttgactttggcttggatgaaaatccatgacctcctcaattgattttcttgtaaaatattacagaataatattgagcaaacattttatttttctccagcctgtatccctccttagcactaacaggtaaagcgaatacctagaggcaaggtttctttagttgggatccattaactgcaggactgggaggtccatagctaggcttcacagggagtgcaaaccccacgtgcagggaaccccgtgtgtctgtgctgtgcccaactcccctctgtgaggctgccaaagggggactgccgggtctcccaggaccccactcacaaagagggagaaagctgcttgctgggcaaaaaaatcaattcaccaattggccaatctgttgaaagccagaaagaaaagaaacgttcaattgtgagactgatgaatgcccaatttcccaagttataaaatgtatagcagctcatggttctcagaatgatttcaacagcatatgaagatatttttagaaagtttttgtttttctaaagcattccttgatattgatcctcacttgtttttcagcccactcatccgttgagcttaatttgatgccaaatttcaatgttgcctatttcagtcactgaccacttctcacattctccatatcttacacagatacgtgtgttcctgtcttttcttctttttgtgtgatgcatttttaaattgggctgtacagaatacaagcatacatttgtaaatgactgccatcttttatgcagtttagctgtttaatttttagtaacactttttattaaggtataattgagagtaaaacacaagtattaatacaaaaacatcctggtacattttgacaattgcatacaccagtgcaacagtaactgaaatgattataaaaaaaatttccatcactcaagaaagtgtcctcatgctcctttccaatcaatttctatcccagagataaaaacttttctgtttttatcaccattgactagctttgtctattcttcagcttcatataaatggaatcatattttattagttatttttctccaaaattagtatttctgaagtgtattcatattgttgtatcagtaggtcattctttcttatgactaatattccattgcataaatataccacaaattttttgtgcattctcttgttgatggatatccatgttattcctgtcttcaactattatgaataaagttgttgtgaacattcttgtggaaatctttcttttggacatatgcattcttttttcttcttttaaaacctacacttaagagtggaaatactgactcatagtgtagatgtgtgtgctatgcttgcgtgtccccacaaaagctcatgttgaaatttgtcagtggaatggtattgggaggtgggacagctatgactaggtcataagggatctgccctcagaaagaaatcaatgcccttattgggcgagtgacttagttttcccgggaatggtcttccaataaaaaggatgaattcagctgttttctctgtcttaagtgcttgcttccccttccttctgccttggataacagcaggaggacctcaccagctgtggccctttgatcctggacttcccagtctccacatctataagccaaataaacctcttgtctttatacattgcccagtccgtggtatttctctatagcagtaggaaagaaattgaaagaaaatatggcaccatgaggctgttgttataatacctgaaaatgtagaagcagctttggttaatgggaagtggctaatggatagaggttgaaagaattgggaggagcagactagcaaaagcctagactcctgaaaacagagcattaagggcaattctggtgaagtgtcagggggaaatgagggacaagctatcggaaattgaagcaaataccatccttgttataaatagcaaaaaccttggcaaaattgtgtcctgttctaggactttatggaatataaaattatgagccattcactaggatatcaactgaaagaaatatctaagcggcaaagcattcaggctactgtgtgactactttcgggcaccaggaaatttcacccagcaagaagggagccatgggaatagattttgcaaaccagcacagatggtaaccctacctccctctgctgtcctgtctcccataagccaaaccctgtgctgtgagctcttaaaatcctagaattatttctggggaatctatactcttaataatttatagacaacccaggtctgctttggatctgatcagacggactaaatcttggggactctgcaccactggccactgaagaaaggggctgggaatgttgatgggacaggaaaatataataagaaacattggtgtgaatctagtatcagaaagatgatgtgaggacaacaaggaagagctggaatgtgagggtttaatcacaggctcctcaccctccgctgatgggtaggtgtgttagctccagcatggagcaccaccgcactaggtgggggaagggtgagagggcaatggggcagcctgtgagctggggcaacgtaggcagagaaggaactgtgtcaccacagaaacttctgccttcacccatcccttcagctctgcaggacaggtagagactccaggatcatccactgagcactggacataaggaaggctgcatggggaggactcaggacagtgacatcacaggatacccctcctattaggaaaatcaaggcccagaattcactcggctcttccccaggaggaccaagccctgaatcaggtgcagtgctgcctgccccactgtgccatgggccctgggctcctctgctgggtgctgctttgtctcctgggagcaggtgagtcctgggcacaggacagcagccccattctcagctttcccacccatgtcctccactttaccttggggaggacctccaggctttctgctgtgctcatcctccatctgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttggcacagcccggcagagtctctgacattctatacataaacttcctgccttagctttgacttgagagctgcaggccccacccaggtttcactcctgcaagggaagcttttagttgtatggaaggcatgtgttgtgtcctactgagcacagagctctcccaaacagagcccaggtttcctatgccctgagtgtgccggcttctgtgcagcatcttcttgcagcttgtcacttcctgggtaacttcagtagaagagtgactgcggagccccagatgtgtgctagattctttgaatttgttatatagcttaaagtctttcaacaaccttgcacatcaatcattcttattcttccttgacagatggaagtctcagggacattcagtcattttccccagtgtctcctggcttgtaaggaccagaagtaggaaacaaagtagtgcatccattttccacctacccccctgctccatcatcaccttctgtgtcctggtcagtaagtcagagccctcaaactgccatctagtgaccagcagggcctcactagaggcttacatgtcttcaggggtcattactctggcctcttcattagaaactttgaggaatgttaaatttaacactttttaaaaatcatttatatgcattccctttgtctatccccagtctgcagcctacactttcatttttatggtgttttacacaagtttaatttaatgcaacaataactaaaaacaattttgtttgtgtgtagacaaaaactgctttctcatataaatgtctaatgatatttttctcaatttattctactaaaatttaagtttggattttcaccaataagaataaatgaacctgaaatatatctcatgtgagaaataagatagagacctaggaattggagggaagcacatatgttcagtgaagaagcaatcgtctgtcaaaaagagctctaaagtggacacctcgtgctgacagtggagagataattggaaggcaaattatcatgaaccttgtctgtctattgtcttgtagaagaaagacagccaggagcagagacaacatgggcgaatgtttatgactggacttcaggttgaaggttgcagcaggtagagggaggagttgcaggcagagggcagaatcactagctggcaggggcagtggcatcaccagtgactctactgacatccaggaattatgtccccaacgcacaagctgaaaaacctcccacaattcgccgaattttccctgaccctgccttggccaccagatttctcaatggtgcggccttttacctcctgggggcaggtgagtcccctaaagccttttccttggcttaccacatcctagcctaagcctttaccacaggtctacattattgaggtccctctttgggcactcaacttccttctatcatagacttcatagaatctgggataaccagatcccaagataccagagaacaaaggcaggatgcgaagcaacatggagatgcctaagactgtcatccatgacatgtgtaggtgttaataggagctgaagctggtgcacagctgatccgtcccagcacacactacagagaaattgctgagggtctgtaactttctctcaaagctaaatatgtggccttggtgtcagacagcctctcccagacctctgtgccctcttgcaccagcagtcaccccacagccaccttcctctgcacacaaagctcagtggaagatataggtggcctcgtcttcacgagactgcgatccaggcagcggaagacgttgtcccatagaagtctccccaacactgcccaggctggggccctcagatttctgagcagctctgtgcatgggaaactctgccctgtgctgagcttctcttccaggccagtctcagctggacgacggaatgtactttaccatgatgtgagtggatgcagcctctcttccaggcccctcctgcagctctggcctcagaagtccttttcttcagttattctcgaaaggaaagctcatttgaagttgtatatttgcagacagcattgacaacacaggtctatgttcttttccctgtcagcattcacaactccatcttccccacaccacgctcatatcagtcctcagcctcctccacgtgatgtccgctcccagctgtcctctcccttcctctgcatcctcacctccaggtcaaccacagatgcctcagttcaggccattcctcacgcgtcatgctcctcctaccaaagccctttccactccacgctgtatcctctgggtcaacacaagtctcttcttttttgttcttgctccaaatctcagtttaaccactaccatctctagggatacgctccttcaacagttttcctaggctgcacctccttaatataaatcctcacagctcataatgtgcgttagtattcatagatttaacaccattgtcattttccatgacttcgggtgactaatggactcttctcttgctctctagactgtaaaacgcatcattttagaaattgtggatgttttgttcctgattttatcatcagtacaaacagcggttccaggtgccagtggccaatcttgaaagaataaaggatggatagtgaaaggccctctgggttcccacgtagagtgtttcagaagtctggacgcattaagcgggaacctctatcccttcatctcctaggatctaatgagtcctggaaacagaggagaaatccctgtcatggatgagtaactggatccaagcctttctgcaggactgaatttcctaactgcccaccgccttcctggcttttctcctccaatgtccttccctcacaggtgtcctggatttgggagtctcacagacacagcacacctaatcattggcagagtggtgtgaaatatagcattaaatactggcattaaaaggtgatggaggctgggtgcagtggctcatgcttgtaataccagcactttgggaggtcaaggagggcagatgatgaggtcaggttagcctggctaacatgtgaaaccccaactctactaaaaatacaaaatcaaaattaaccagccgtggtggcagtcgcctatagtcccagctactcagtagactgaggccggagaatggcgtgaaccagggaggtggagctcacagtgagctgagatctcaccagtgtactccagcctgggcgagagagcaagactctttctaaaaaaaaaaagttcatggagaaaaaaacaaagggcttctccattctttgggtggctttgaggccatggtggctgctacactgaactatatcattagtctccatttccatgaattggtgggcaatgccagagacacagagttcatggtcaccagcttcctccagcccacacctgattttggttcagggcactgaagagagacctttgcttgttcccctcctttgccagttaggaaaggctggttgtgaggcagaggctccacatatagagcagggctatgtgttagtccctgaagaattgtgagagccattctgggtggaaataatcaaatatacaatcaccaaggatggcctacagatagaccgaagccccaattttgctggagtgatttgcatctatgctttaaagacaaatgcagttttatctctttaggcaataaagaccaaaaatagactagctattttaaataattgaaccttaaacagaccacagtcagaacatcttccctagggacagcattttcttccacccactcactaaagctctatttgagaaagctgtgtgctgttgataaacactggaatatcgttacaatcgacattgtaataatactgctacttggatcagaaacaaagagcatttctaaagcttgaacaatgtaaaactggaaacgagctctcactgagtttggaaatgcaggcactagagggtgctcatttctcttccttttccaatcaggggctattcaaaggctgttctagaacaaggggtgagatcctccacttccccgtggtgatcaggctttcacaggtagaagccttattagttcataatcagccaagctgacctcaccatcaaatgtatcgacctcgatgcttaccctcctcagcagtcagagactgtctgtgttcaccaggagctcgtgtgcttttacagagcacactttctcctcggtttagtaaaaaaaataaatgggccattatagggggttccataaacagaagctttctgtactttgcccatttagacactacaaattctgatgtctgacgaatagtgtaaacttaaagcttgcatgtggttaagaacttttaataaacaaattaaataatatatataatgaaaatgtcaataatgttctccaatccaatcccaccttccactcataaccaatattaacgctctggtgtgcttcttttcacccctcttttctgtgttcatgcacacctttctacccaagtacacctacagaaaatgggttcacctgtacactttacctgccacatgcatactcttttctgttaatatatcctggtctttattgttccagattggttgatatagatctaacttgctcctattagctgcttcacattgcataatgagggtagacaggtacatttgtgctctattgtctgattcctaaattctgccagatcttttccaaagtgactgaatggcctctttgtgcttccgagttcctctcaccccagcacccagttgatgattccagcgtttccatcactcatagtcctggcaggtttgagagctccattggttcctcctgcatgaggagacagggacggataaaaggatagacctttatcaaacctaacagagactacacggtatctcagttcaacctcataaagcattgaggggaatgttagtcttgttttatagatgagtctagatgaggctagaatccaggaaagttaatgaatggccttgcccacggtctcagagctaataaatggtggaggcagatgaagggcagtcagcctgcttccatgtggaattgatagaggggtcactggactttgacagaggggaagtctagaaccatctggggctgtcttcagatcggacaccagagttaagagagcctgtgtaccctacagcactgcagatagaagcatcatggtgttggcagtggggaggtactagagtgtgtaagtggttagtggcctacaaccagaagacctgagttttgagaaaattattcccatcacaagatgtagcagagacagtgatatggatatactagaccagagagctctgtgaggagctctgtgaggagctgtggcctaatcatgcatcaggccacgtttgtgtccataggtcatgggcagtgctgggtggccaccatcattcatacagagagggcagtcagcagcgtgaggtggttctgcctgctgtggtctcaccccaggcatggaaagcaagagccctgggagcagcggaaggtgctcagctgggcttgtcaggagtctcatctgtcagtggattgacaagaaacagagcaaaatgattcctccaatgttgatgagcctgcccgtgggatctggaaagctaataacagagaaaaccaatatagacaaaggattttaaacaggattatggtcaattaagcaaattagaaaatgatacttgaaggagtatttgggacgcagtagtcaaaaacaccaggaagacatgaggaattgccctaagactctagactacagcactatgtagataactaacaccagactattaattatatcattgaaaaaataaaatttacagtaaattacaaactgtttaccaaaggttatgaaaatcttgtagacttgttttaattcagacaaatgttttcttctcattgtcagctgttctctggcgcatttattttggattgaaccatctggggaagaggcgtggcctctcctgactggaaggctctggggcccaggcagggagaatgaggtctcagaatgacttccttgagagtcctgttcccctttcatcaatgcacagatacagaagacccctccgtcctggagcacctgccatgagcatcagcctcctgtgctgtgcagcctttcctctcctgtgggcaggtgggtcccggacagggccccttgcatagatttcaaagcccagcccctttccattggggctgcagcatcagctgtttccttctctgcaggtccagtgaatgctggtgtcactcagaccccaaaattccgcatcctgaagataggacagagcatgacactgcagtgtacccaggatatgaaccataactacatgtactggtatcgacaagacccaggcatggggctgaagctgatttattattcagttggtgctggtatcactgataaaggagaagtcccgaatggctacaacgtctccagatcaaccacagaggatttcccgctcaggctggagttggctgctccctcccagacatctgtgtacttctgtgccagcagttactccacagcgctacaagaccatctcctctctgcacataaaggcagggtggctctgcccttcctcccccacccaagactcagggatgacctgggcagagttttctgcaatggggaccttggaaccccgagtggccctaagtggcccggacagtatgagcctcagtctgtgccgggtgctcctgcagccatctcagccaggcctggactggtcccaggtcctcagatgtctcctttgttgctctctctggtctatcctctgagctctccttttggggttgggccagggcttccccagctcctacttttctactcatcatcctgactccgaggcccccaggatgaaacaggatttgtatttcagatccatctaggctgtcctctccctggtgagcatgctgcttcctctatctagagttttcccctcccccaccccacccatggtctgtcctgtggcctatctttcccatctgggcagtcaccttccatcccccgcctccccgcccctctctactgcagccatggggggagcacctcttctgagactccttccttcccatcacagagacttcaaaggccatttcctctgccctggatggagacttcctttctctagtggccagctcctacctgtgcttcagatctcagaatgatctgccctcccgcaggaagcaatccctcaccgcccagctgagatcaattttcctctcataagctctcatagaatcatatgtctcttagtaacccttaggacaattaggctttctcagatacttgtctgatgatttttgtgctctacccaattttttttttttttctgagacagtctcactctgtcaccaggctggagtgcagtggcatgatttccgcttactgcaacctctgactctgattccagtgattctcctgcctcagtctcccgagtagctgggattacaggcatgtgccaccatgctcagctaattcttttttgtatttttagtagagatgcggtttcaccatgttggccaggatggtctcgatctcctgatctcatgaaccacctgcctcggtctccgaaagtgctgggattacaggcgtgagtcaccgtgcccggcctctccactcaatttttgagcccatgagagctaaggctgtgcctgctgcattaacaacatcagtgcctggcgtgtggggatacccatttcacagagaatggatgagtgaacgagaggctgaatgagtgatgagtgggtggacgaaccaatagtaggaacacactacatctactgtaaactggcagaggtctagcattaagtacaagaaagcccacccctttgattgctgggctcaggtcgatcttggaaattgatggggaatcactatcatggcggccacatctggctcaaggctttctcttgtggctgcagtacctgacctcctccaggtctctgtgctctctttcagggtctttccccacaacaaatctagacagatcagagatccacttctagaattccatccttaaaggttgttccttgaaaccacttctggtaagaaaatctccattaggtttgcatcaataaaacagggccactacaagtttgagagtgtaacagatttatgatcagaattagactttatgcatatgtgggaggagctgaggaagacaaggtctggaggagagaagtcagaaggtgagggagccagtcagtagtcagggctcctgaagctctgggcaggacaggctagagtggcagggacatgagaggatcagagcataccaggacatgcagtgggaccttgagccgggagcacaggaaaaggccaaggaaacctgcttctggggaagctgttccttgtctatgggggccacccctgcaggtgcactgccaaacactgtgggcagcctggctgctgttggccaacatttgggaagatgaactggacacagggtgcagaaggaacaggacttccaaggtctgttggatgcctctgtatctgctggtcactgactctcactgtctgaccacaatgacttgccaattgttatagtgactgttttatatctgtcttctaaattttaccaaatgtatccttgaccatctctaaccagaatgataacagaaatggcattctgggaaagtcagactcttcatttgcaaagttgacttaacacaatccagcacaggatggattctcccagattaaggcatcagatcacacaactgtctcgacctgccacggtccatggactcctctccgggggacacctgtgctgcccaggtgaatgtggacacaatttgtatgtagatgttccagacgctggtgactaacttttcttttaatactgtgtctgaagtctctctcacccagagggtctatatatgtatgagtatatatgtatttataaatatgtatgtgtaatttctccttagaagaaaatgtcatgatgactacatggcttaatggcatttatttatgaaagagctttattaaaaataattagaaaatttgaattctattctgaatttttccttgggagtgtcctgagagcatttttgaccctaccgacttttgtcatgtgtgtatttggcagcctagagtgcagcagttattggcgccatacattagggagttagactggagatggctgcaaaatgactgactcttagtgttattcactctcactctgggcctcactggaatgtcacagactaccatcgaacaaatggattcccagtatgaagaatattaggagatagcaatgaggaaacatgagcacaagcaacaaacatttgaagtgcaaacctgaagactcgaaatgttggcattataagatatgaaagtttggtgagctacatttaaatgaacatgacggggaactgaaactaggaaaaagacaatgcctgaaaccatcaactttcataacaattgtcaaaaaatatatctaggaatgcctcatacaatcactgaaaacaaaatggaaagtcaaacagttgattagctcctcctacagagatttttagtgatttcaaagatggatctgcaggagtgatctagaatgcagcacggaaaatgaaaagtgaaatatgaaagaagttagagaacagggaagaaaaaaatggatgtttcccatatattagaatatgcatatttttcataatttcccattttttgttgcatatgattgaattttcagacagataaaataggtagaatgttatgaggtgatatttatgagatgttagctgagaagttttttgaggtgtttaaggacctaaattcagagtttccagaatcacaatgaatctcaaataaggcagtcaagtcataagcaaattgtagaacatgacggacaaagagaagattttgaaagccgtcagaaagaaaagacaaatacgtcccataggaatagatggagaacaacagtaagttaagacagtggtaaaaataaccattagctcaattatcattctccttcatttaaggtaagattgattaaaaaaaataacttttagaaggggaacatgaaaaatgactgctgtgagtttgctatcaaggtttcttttctgaattacagttaagaaaggtgggaaatgatcccagaagaaaggcatgagggcagttcgtgaggtaacccaagtgatggggctgcccgttgggcacgtgtgactgagggaatggaggaggctggggcataaatggggatggcagaggggaccctgaattgcaggatagacaatgagctaatgccttggtgccttgttttggggatgctgttggcacatcctacaagacatgcccagcagacagaggagtggctgtaggatgagaagatgaactcagagatgcagtgtgagcctctggctccagacagcacgggagcccaaagcaatgagccaggcattgatgttgttaaaaaggagcttataaatatttaaagtgtgttctaatataaatactgtgaccctgacatcctggggattgagagaggaagtgatgttactgtgggaactgccctgtggagacaaggacattcctcgtcctctgctcctgctcacagtgacactgatctggtaaagcccccatcctggcctgaccctgccatgggcaccaggctcctctgctgggtggtcctgggtttcctagggacaggtgagtcctcagaacattaagtagttttattttttctctgtgtgtaggtgtgtgtgtgtttgtgtgtgtgtgtgtgcgatgactacagatgttttccttattctgttgccaaattctatttccacagatcacacaggtgctggagtctcccagtccccaaggtacgaagtcacacagaggggacaggatgtagctcccaggtgtgatccaatttcgggtcaggtaaccctttattggtaccgacagaccctggggcagggccaagagtttctgacttccttccaggatgaaactcaacaagataaatcagggctgctcagtgatcaattctccacagagaggtctgaggatctttctccacctgaagatccagcgcacagagcaagggcgactcggctgtgtatctctgtgccagaagcttagcacagcgtggcacagtcgcgtccttcctgctcacaaacctcatccttctctctccttgcacctcctagagacccttaatagaggcctatctttgatcctcacttttcgtgggaaataagtagatttggacatcggctgtcctttgggtagaaagagaccacagattcattcctgaaacacagtgactgcaaatgtaggtggtgaaaacaatcacgtcccactgccctctaggagtgcttggagccagctcactgctccaaacggagtgggtgtcttagcattggccttcagggcagacatgcatcttctataggtcttggaggctgctgtgttacccacatatatgaggttgtcaagggcaggaaacatgctcttctcctgcatattttggggcatctggaaggtctgaggctacatccccaggaatatctttcttctaaagcctcttctattcctgtcaccttggaaatttttgcaacaaaatatcgaacctctcttcctgtttaaagtaaaggtctttgcaactttcgtggtctttacttgataaatacaatcatggtaacaataagacttcatttcttctgcctactttaagccacttgtatcctttattttatttccatttgccattgctactgtcctgatagacagaagcatgcattcaccactgctgcctgttcacatcgattccctcaggaaatctgatttttagactctgagtgttttcattgttgtccaactcatttgatttgaaataatgttaccgaggcctttaactcaagaagtgttttatttataatattgaatctattcctttttattttatttttcataatagatagtactatatagtacttgttataaatagaagtacaatgattatattgcaatagaatcttccacctatctgtgggtgctgctgcagtgtgtatctgtgaaagcgaatgcactggtcagagctgatgtgattatggatcgtgggtttctgggagtccttggcgacagaccacttctccaagtgtgggactcagtgtcccagatgcaaccatgatagaggtgccctgagtctttcatagctaggaggggcatcatagtccttccaaattcactgatcagaaattgtggtgtggtacagataccaaatttctttctccagagaatgatggtcactggcagggagttgctcttgacccattttttcttgtgtcgtcatcaaatccctccttgctcaggtgccctgtgtctcctgggactgagtaagtccagagcacagatgggaattccctgtcttcctagaccctttgtctaactgctgccactttcctccatgtgactcctgagatagctggtcctaacagtggacaagctctgacactgaggctgaagaaaacacagtctatagttgtcaacggcgctgcaagaacatgtagcaaaaacgagcagggcttccaatttatactgagaatgaacatgcaagaggagcaaagggtagaaggtactaatgaacaaatagcaaggaatgcagtttctgttctaatgaagtcattctgttgtcttaagttaagtaggagaaaactttcacagtaattacatcaagtcaaaggctagcggctccccaaccaaccaacatagctatttgctctgtgatcttggcagcttcagaggactcagaaatcctttctctgcacaaacatccctttgtccattccaagatccaggatcacacactgatcctatcatgaaaacaatgaggtgtgctatagttgctgtggcctcattttagtatgttgagtaggaagcattgacgaactttgaaagctttgctcttgagtctagggatgtgctggagccagcttgtatgagtcagaagaatcaaataggcatacttttcccagctccctgttcagtgaagccatgctgggagcttgaaatctgccatggtgggtatgttggtacaacagaaattagcaaatgctaccagccatgcccccaccttcacagacacccagtttatcagcacatcactggagtattttctgatgtccctgttatgccatgtcttttagggacaaaagggctcagaatttatgtctcctctactctgttcttagaagccatcatctaagggggccttgattgctcccatttctatccagctcccaaattctcttgctctgtagctctgtgtctcctgcaagcacgccagtctggaacatgacaactattttgaatgtaactaaaggtatcactgaaccagttcattatttacaaattatctttccttgcatggaatattcagatgctggagtcattgggaacagagatggccaagcagcaactctgggttgtgaaacacttacagccccgctattcttctgtggcaacgagagaccctgtaaaaaggacaattttgctttggagactaagcagctccccaccagtcaggaatgactctgcttttactttaggctgagaggtcagaagggtcacaccctcaatattctcctctccaagacggagtgtggccactctccatctcagtccctggaagttgtccagagctccccgagaatccctgctctggaggcagaatcaccaaggctcatcctcaccagctccccacaggctccagcagggctttcccaccaggtgcagggcacaggaatggctctgcctgtctcttaggtagagggaggccaaacagtgatgtttgtataagagggactggggttctgggtctcctttaaagtatttgacaaaattttctttgtttttgttttattgtgccatctcaccaatgaggagagcaatcccttggtagttatattgtttttggcacttgggaaggtttttgtggttaagccacattaagaaattgtgcctttacaggaaattatgctgtacaggaaagttcagctgtaacccaaggcagtgaaagaaatagcaataattttgagagcagttacttgggtatctatgataaaggtgttaagtttcattgcctacatctaactttcagtctagtggaaatgaaaaggcacagttagggggcatgtgagcatgccatgagagagatcgatgccaattgagaagtctgtgccattccccaatactgtgggattgaaggggagggagagatgacctctccttcagactgtgctcaacaaggagggagtgggagttcatccatgggaatctgacgaggagcaaatcccaggggcctctaactcagggtgcaggagcaaatccttggagaggaaaatggtccagttcagctgtcacaggagacaggagaaagcaaagtcatctaatccacagtctcccggctgatttgcttccttatgatgctattttgtaccagcgtgtcctcatctcccgctgctcctctgcctgtttcagaatcatctcttccgtgtttggtgctcagatcagtggatgtgcattgtacaagctgatcatttcctgtagcagcccctttgctagtcttagttatatccatccttattttctgcattaggtactgctccctccaccattcattgcttattgccttgtaagaggtctcgttttatatatttcaattttactttttattaatagatatttgacttcatcttttgctgatctatacttttggggtaacattgtcatttttggaggacgatttgtttatctttagtgattcagattaaataatctctttatacttcaatgtctgtgttttcttcctattttaagccaaatattatttcctttcattcctctccttctgttactctttctttagatggtagttttaagggagaaaaagttaaactataactggacctatgtgataagtgttattcagaatgagggtgggatattaagattggtaactcaaagcaataatcagggttagaactaatgttagacttagggtttaagggaagctgctcataaaaccagcgtgatggcacttctggaatattctggcagcttcctctgcagacacttcccagcattccttgggccattacagaagaaacaatgttgaaacttcacgtattggccacaagatggcagtgtggtccactgagctcgaaagggctctggggagtctaggagagcatcctaggagggaaagggttaagaaaaattagggcttggatcctgtattatgcagatgttgcagcagctttcagttattgctaggctacctacagctatgcaagagacgggaagtccctctaatctttaatgacatctacagttgaggaattttggccggggcaaattttggtcaggggcaggtgtagaggagcaactgcctcagaggaaaagggaaaagcgaggggtgggctgtgtcctgagcccagtgcgtctctgctgcacctcatcttccctgcaggtctggccaggcaacagctttaacctgcttgagtgatctggaattctagaagttcagaagtcgtactgataacatcaccttggctgagattccattggacaccaggcatgtgttctctggaggacaaaaaatattgagaacaagctctaaaacacctaagtaaacagactacagaagaaaaatgttagtagatgcaccaaactgtgccgttagacctgatgataattgactagtagaattaccaaaaagagactataaataagtctccactaagtatttgtgttattgagagcagtgtttaagtcttctcagggtagattaaagaaggaattcagctattatcatgactttggcttggatgaaaatccatgaagtcctcaattgattttcttgtaaaatattacagaataatattgagcaaacattttatttttctccagcctgtatccctccttagcactaacaggtaaagcgaatacctagaggcaacgtttctttagttgggatccattaactgcaggactgggaggtccagagctgggcttcacagggagtgcaaaccccacgtgcagggaaccccgtgtgtctgtgctgtgcccaactcccctctgtgaggctgtcaaagggagagggccgggtcacccgggaaccccactcacaaagaggggagcaggctgcttgctgggcaaaaaaatcacttcaccaattggccaatctgttgaaagccaaaatgaaaggaaagtctgaatgtgagagtgatgaatgcccaattttccaagttatgaaatgtatagcagctcatggttgtcagaatgatttcaacagcatataaagatattgtaaacagcttttgtttgtctatagctttccttgatattgatcctcagttgtttttcagcccacgcatcagttgagcttattttgataccaaattttaaagttgccacttcagtcaccaagcacttctcacattctccataacttacagatatgtgtgctcctgtcttttcttatttttgtgtgattcatttttaaattgggctgtacagaatacaagcatacatttgtaaatgactcccatattttatgcaattaactgtttactttttagtaacaattttatttaaggtttaactaatagagataaaaacagaaatattaatacaaggacaacatggtaaattttgacaaatgcatatgccagagcaacggtaactgaaatgattataaaaaaatttccgtcatgcaggaaagtgtcgtcatgctccgttccaatcaatttctatcccacagataaaaacttttcttagttatttatttattttgagacagtctcactctgtcgcccaggctggagcacagtgctgtgatctcagctcactgcaagctctgcctcccgggttcatgccactctgctgcctcagcctccagagtagctgggactacaggcgcccgccaccatgcccggctaatttttgtatttttaatagagacggggtttcaccgtgttagcctggatggtctcgatctcctgacctcgtgatccacccacctcggactcccaaagttctgggattacaggcatgagccacggcgccaggccaaaacttttcttatttttatcaccattgactagcttggtctattcctgcactccgtataaatggaatcatataacatttttattgagttattttcctccaaaattagtatttctgaagtgtattcatattgttgtatcagcaggtcattctttattatgactaatattccactgtgtaaatataccacaacttgtttatccatgctcccgttgatggatatccatgttactcctgtcttcaactattatgaataaaattgttgtgaatattcttgtggaattctttcttgtggatatatggattcttttttttttattttcttttaggtatagacttaagagtggaaatactgactcacagtgtagatgtgtgtgctatgcttgcgtgtccccacaaaagctcatgttgaaatttgtcaatgtaatggtattgggaggtgggacagttatcactaggtcatcagggatctgccctcagaaacagatcaacgccctattgtgggagtgaataagttgtcttgggaatggtcttctgataaaaagtatgaattcagccactttctctgtcttgggtgcttgcttccccttctttctgccttggataatagcaggaggccctcagcagttatggccctttgatcttggacttctcggtctccagatctataagccaaataaatcccttgtctttataaattacccagtctgtggtatttctctacagcagtaggaaagaaattgaaagaaaacatggtgctgagagtggcgctgttgctacaacaaggacctgaaaatgtagaaacagctttggttaatggcaaatgggtaatggatagaggttggaagaattcggagaagcagacaagcaaaagcctagattgctgaaatagatcattaagggtaattctggtgaaggctcagggggaaatgaggaacaagatatcggaaatcaaagtaaatgctatccttgttgtaggtagcaaaaaccttggaaaaattgtgtcctgttctaggactttctggaataaaaatattatgagctattagctaggatatctactgaaggaaatatctaagcagctaagcattcaggctattgtggactactttcaggcaccaggaaatttaacccagcaagaaaggagccaagggaatagattttgcaaaccagcacagatggtgacactacctccctctgctgtcctgtctccaataagacaaactcgctctggagttagagaaaagaggagccagttaacataatacactggggtcagcttctgaaggcagggtggatctgaagggaataacataaactgtccagagcactacgtataggatgaccttgagggtgctgagtcccaagctggctaggtctgtgctatgagctgagaaggccctagaattatttctggggaatctgaactcttgataatttacagacaacacaggtctgctttgattctgatcagatggactaaatcttggggactctgcaccgctggccactcaggaaatgggttgggaatgttgcctgagacaggaaaatatgataagaaacatggtgtgaatctagcatcagaaagatgatgtgaggacagcaaggaagaactgcaacttgaggtttaatcacaggctcctcatcctcccctgatgggcaggtgtgtgagctccaggatggagtaccacagcactaggtgggagaagggtgatagggtggtggggctgcctgtgagctggggcagtgtaggtagaggagcaactgtatcaccacagaagcttctgccttcacacattcctccagctctgcaggacaggttgagtccagggtccgtagtgcgctagacttaaggaaggctgcatggggaggacacaggacagtgacatcacaggatacccctcccatcaggaaaatcaaggctcagaactcactgggttcttccccaggaggaccaagccctgaatcaggtgcagtgctgcctgccccactgtgccatgggccctgggctcctctgctgggtgctgctttgtctcctgggagcaggtgagtcctgggcacaggacagcagccccattctcagcttttccacccgtgtcctccactttaccatggagaagacctccaggctgtctcctgagctcatcctccatctgcttttcccacaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagcttggcacagcccggcagaatcactgacattctgtatataaacttcctgccgtaactttgacttgagagctgcaggccccacccaggtttcactccttcaagggaagcttttagttgcttggaaggcatgtcttgtgtcctactgagggcagacctttcccaaccaatagagcccaggtttcctgtgccctgagtgtgcctgcttctgtgctgcatcttcttgcagcttgtcccttcctgggtaacttcagtataagagtgactgctgagcgcttggtgtgtgctagatttttgtatatgttacatatcttaaagcttttccacaaccttgcaaatcaaacattctcatccttcctttacagatgggaggctcagggacattgagtcattttccccggtgtctcctggcttgtaaggatcagaagtgggaaacaaactagtccatccattttccacctacccccctgtttcatcaccaccttctgtatcctgttcagtaaaccagagccctcacactgccctctagtgaccagcagggccgcagcagaggctcagatgtcttcagggggttattactatggcctcctaattagcaattttgaggaatgttaaatttcacactttttaaaaaatcatttatatgcattccctttatctttcccatgtctgtagcttacattttcatttttatggtgttttttgatgtacaagagtttaatttaatgccacaaaaatgaaaaacaattttgtttgtgtgtagacaaaaacttctttctcatataaatgtctaaacatatttttcttaatttattctagtaaaatttaagtttggcttttctccattaagaagaaatgtacctgaaatatatctcacgtcagaaataacatagagacctaggaatgggagggaagcacatatgttcagtgaagaagcaacagcctgtcaaaaagatcccaaaatggacaccctgcgctgacggtggagaggtagctggagggtaaatgatcacgaactttatcaagctgttgttgttagaagagggacagccaggagcagagaccacatgggtgaaggtttatgacttgactctaggttgaaggttgcagcaggtagagggcggaattgcaggcagagggcagagtcactggctggcaggggcagtggcatcaccagtgactctactgacatccaggaattatgtccccaacacacaaagtgaaaaaactcccaacaatctgcacatttttccctggccctgctctggccaccagactcctcagtggtgtggccttttgcctcctgggggcaggtgagatctttaaagacttttccttggctcaccacatcctagcctaagcctttacatcaggtctgcattattggggtccctccttggtcactcaacttccttctatcatagacttcacagatgctggaacaacctgatcccaagataccagagaacaaaggcaggacgcgaagtgacatggagatgcctgagactgccatccatgaatacaggtgcagatgttaataggagccgaagctggtgcacagctgatctgtcccagcccacactacagagaaatccctgaatgtctttgacttcctctcaaagccaaatatgtggccttggtgtcagacagtctctcccagacctctgtgccctcttgcaccaggctttaccccacagccaccttcctctgcacacaaagttcagtggaagatataggtggccttgtctttacgagatcgtgatctgggcagtggaaaacattgtcccataggagtctccccaacactgcccaggctggggccttcagagctcggagcagctctgtgcatatgaaactctgccttgtgttgagcttctctgccaggccagtctcagctggacaaaggaacgcacatcaccatgatgtgagtagatgcagcctctcttccaggcccctcctgcagctctggcctcagaagtcctctttctcaattgctctcaggaaggaaagttcatttgaaattgtatatttgcagacagcattgacaacacaggtctacgtatgtccaatcccatcttccatttgtaacaaatacaaacactgtggtgtgcttcttttcacccctcttttctgtgttcatgcacacctttctacccaagtacacctacagaaattgggttcacctgtacactttactggccacatgcatactcttttctgttaatataccctggtcttattgttccagattggtcgatatagatctaacttgctcctattagctgcttcatattgcataatgagggtagacaggtacattcatgctctattgtctgagtcctaaattctgccaaatcttttctaaagtgactgaatgacctctttatgcttccaagttctcctcaccccagcacccagttgatgaatgcagcttttccatcactcataatcctagcaggtgtgagagctttatcagtttctcctgcatgaggagacagggagagataaaaggatagatgtttatcgaacctaccagagcctacacagtatctcagttcatcctcataaagcatggagaggaatgtgcgtcttgttttatagacgagtctagatgtggctagagtccaggaaggttaatgaatggcattgcccatggtctcagagctaataaatggtggagccagatggaggacagttggcttgcctctgtgtagaactgatagaggggtcactggagtttgagggaggtgaagtctagaaccatctggcgttgtcttcggatcagacgccagggggcagtagagtctgtgtaccctacagcactgaaggtaaaagtatcatggtgttggcagtggggaggtactagagtgggtatgtggttagtggccaggaaccagaagatctgaactttgaaaaaatttttcccatcacaagacgtagcagagacactgatgtggataatctaggccagagaactgtgtgacgagctgttcttaaaatgagggagggaggagaagcaactaagggtcacttcctctacatgaaatggagaggaaaacaatgttaactagaatctcatctgattttagtcagttttgctttgtaagtagttgcaaggtgggacaatttatttttgacattaagtaaacatctatacggcttctttaccttatgaagtctggtggtgaaggcaaaaatggtacggccaatggagtcacagtttgtttaataaataactcagagttcaaatggagactctcatgggccagaaattggtaaatgttcctgcattctaaaattaggaggatcttattttctttgaatcaacagagaaggaagcacaggcagtggggagggacagtagggaactcggcagagtggccacagaatgtggaagacaaaggacatgtaataccaaattctaagctgtgaagttgtgatgcaaccctcctccttctcctaatgtttttcaggtctcagcacagatgcacacctgagggagtaacttctttggaaatgaaggacaaatagctgtgtaataataagtccaccttacaaagcacaactggaaatggaaacaagattatttctaaggccttttctactctaagagtaacttagtagcaagctgagaggtgaggatggggggatgttcatccacacgcaatgagtaccatgaggctctaccatgaagcatatagtcctcagtgtgaatcagagccctaagaagaataatgccctttacattgctttgccctctgccatcctaaacccatcccacccataattaagcagccatggaaatgaagggagccagaaggaatcaaaccctgctgcttggttcagtagacagagggacctgggggcagggtgttggctgggtctaggagaagatgatgagctcagaaaatagacaaggagaaaccccaggggaaagcttgtaaaatcctggaggaatcacaagatatattatttgagctcctttttatttattactaaattaatggcaggaatcccatataaagggatattccttatgaaacatgacatctaaagtacaaacagaggattcttccttaccctaaatcctgccctctctccctgagtctcttacgcatcaggccacctttgtgcccataagtcatgggcaacgcagtgtggtcaccttcatccacacctagaggacagtcagcaaagtgaggtggttctgcctgctgcggtctcaccccagacatggaaagcaagagccctgggtggagctgaaggtgctcagctgggtttatcaggagtctcatctgtcagtggattgacaagaaacagagcaaaacgactcctccaatgttgatgagcctgcccctgggttttggaaacctgataacagagaaaaccaatatagacaaaggattttaaacaggattatggtcaattaagcaaattagaaaaagatacttgaaagaatatttgggacacaggagtcaaaaacaccaggaagacatgaggagtgtccctaagactctagactacagcactgtgtagacaactaacaccagaatattattatattatcgaagtaataaaatttacagtgaattacaaactgtttccaaaaggtcatgaaaatcttgtagacttgtttcaattcagacaaatgtgttcttctcattctcagctgttcactggtgcatttatcttgaatttgaccatctggggaatgggcgtggcctctcctgacaggaaggctctgggggccaggcagggagaatgatgtctcagaatgactcccttgagagtccagttcccctttcatcaatgcacagacccagaagacccctccgtcctgcagcccctgccatgagcctcgggctcctgtgctgtgtggccttttctctcctgtgggcaggtgggtcctgggcagggccccttgtgtggatatcaaggcccagcccctttccactggagctgtagcatcagctttgtccttccctgcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagttactccacagcgctgcaaggctgtctcctctctgcacataaaggcaagggaaggtgctgccctcctcccccacccaagactcaaggatgccctgtgcagagatctctgcaccaggaaccttggaacccagagtggccccaagtggcccggacagtatgagcctcgctctgtgccacgtgcctctgcaggcatctcagccaggcctggactggtcccaggtcctcagatgtctcccttgttgctctctctggtctgtcctccgaggtctcctttcgggttgtggccagggcttccccagctcctacttttctactcatcatcctgagtccgaggcccccagggtggaagaggatttgtatttcagatccatctagactcctgtctcttcctggtgaccatgttgcttcctctctctagggttttcccagcccccaccctcacgtagtctctcctgtggcccacctttcccatctgggcagtcaccctccaaggccttgctgggtctctcctcccctcacttccccgcccctttctactgcagctataaggggagcctctcttctgtgcctccttccttcccatcaaagagatttcaaaggccattccctctgccctaggctagaggctaccttttctactggccagcgcctacctgtgcttcagatctcagcataatctgcccctcctgcaggaagcactcccccgcctcccagctgagatcaactttccactcaaaagctctcatagaatcatgtgtctgttggtaacctttagcacagttgggctttctcaggtacttgtctgataatttttgtactccacccattttttttccctatttttccttttttttttgagacagagtctcgctctgtcaccaggctggaatacagtggcactacctcggctcactgcaacctccgactctccgactctctggttcaagcgattctcctgcctcagcctcccaagtagctgggattacaggcacacaccaccacacccagctaattctttttggtatttttagtacagacagggactcaccatgttggtcaggatggtcccgatctcctgacctcatgatccacctgccaaggcctcccaaagtgctgggattacaggcatgagccactatgcccagactctccaccgaatttttaagcccatgagagctaaggctgtgcctgctgcatttaccaacatcggtgcctggcatgtggggagacccatttcacagagaatggatgagtgaatgacaggctgagtgagtgatgagtgggtggacgaaccaatagtaggaacatgctacacctactgtaacttggcagagatctagcattaagtacaagaaagcccacccctttgatttttgggctcaggttggtcttggaaattgatggggaatcactaccatggcggccacacctggctcaaggcttcctcttgtggctacaacacctgaactcctccaggtctctgtgctctccttcagggtctttccccacaacaaatccagacagatcagggatccacttctagaattccatccataaaggttgttccttgaaaccacctctagtaagaaaatctccattaggtttgcatcaataaaacagagccactacaaatttgacagtgtaaccgatttatgatcagaattagaccttatgcatatgtaggaggagctgagaaagagaaggtctggaggagagaagtcagaaagtgagggagccagtcagtagccagggctcatggagctctggcaggacaggctggagtggcagggacatgacaggatcagagcatgccaggccatgcagtgggaccttgacctgggagcacaggaaaaggccaaggaaatctgtgtctggggaagctgttccctctgtgtgggggccacccatgtacgtgcactgccaaacactgggggcagcctggctgcttttgggaagatgaactgtacacagggtgcagaaggaacaggacttccaaggtctattggatgcctctgtatctgctggccactgactctcactgtctgaccacagttatctgctatgtgtaatagtgactgttttacatctatcttccaaattttacacaaatgtatccttgaccatctctaacccagaatgataacagaaacgtcactctgggaaggcagactcctacctttgcaaagttgacttaacacaatccagcacaggatggattctcccagattaaggcatcagatcacacaactgtctcgacctgccatggtctgtggactcctctccaggggacacctgtgccgcccaggtgaatgtggacacaatttgtatgtagatgttccagacactggtgactaagttttctttaatcgtgtgcctgaactctcactccacccagaggcagggctctgcctcctgcttctgtctccttcctgagcttccgtcctgctggagttgcatggacatcagaaccctggtcagagtgcagcgacctgtggagacagtgggagggaagctcacctcttgctgtcttcctggacctagttcggttatacccaaagcaacttctctggtctccctttggactctgcagtatcagaaatgtgcttcatgaatttgtagctgatcagctcaatgatttgatggccaacccaaagtgaaatcctaagatctgcagaaattgccggcatttctgtgaagatggcaagaatactgtgtgctagagatgccttctctccatgtagagacctggccccaaaacaagacagagcagagagggccaaagagcccaaaacatgtctcagatggttgaagggcaatttcctaggacaatcctgctgacaaaatttcatccctcctattacacgcctgaccacccttctccccagatcagctgagtacccaggatatcacacatcccagcatcttctaacaagggaaaattcttcacatgccagccttcttcctgcaccacattgactaaccctggaaacttcgcctttccagaaaaaagctgtcttctcttggcccagtctagcccagtaggtttaattcatgatttatgtgaccttttaatttactcagaggagaacatatgatttcagagtaaagaatattcattttactttgtataagttggacctaaacagtaaactgagtacttctcttccatcagtgtcttaaattagacaacggtaaaacaaatctttgatgcaagaactttaggtcctggtgtttttcatatggaagatcccagctatccagtccagggcatggaatagatgagcgttaataagtcactctatgcctgagatggttttctattggcatcttttctgagttacagttaacaaaggtgggaaatgatcccagaagaaaggcacgagggcagttcttgagggaatccatgtgataggacagtcattgggcacgtgtgactgggggaatggaggaggctggagcatgaatggggatggcactggggaccctgacttgcaggaaatgcaatgagctcaccactttgtgccctatgttaggggcggtgttggtgcatcctagagtaaatgtccagcagacaaaggagcaagaagcggctgtgggatgacaaggataaactcagagatacagcatgagacctccgggtccagacagctctggagcccaaggcgatgagccatgcattgatgttgttaaaaaggagctgataaatatttaaagcagcacccaactgtgttctaatagaaatgctgtgatcctgaggtcctggggattgagagaggaagtgatgtcactgtgggaactgccctgtggagacaaggacatccctcatcctctgctgctgctcacagtgacactgatctggtaaagccctcatcctgtcctgaccctgccatgggcaccagtctcctatgctgggtggtcctgggtttcctagggacaggtgagtcctcagaacacaaagtagtttcatttttttttctgtgtgtaggcgtgtgggcgtgtgtgtgtgtgtgtgtgtgtgtgtgtgtgtgtgtgtgctgacgacaaatgttttccttattctgttgccaaattctatttccacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcttagccacagtgtggcatagtcgcctccttcctgttcacaaacctcatccttctctctccttgcacctcctagagacccttaacagaggcctctctttgctcctcacttttgatgggaaagaagtagatttggacatcggctgtcctttgggtagaaagagaccacagattcattcctgaaacacagtgactgcaaatgtaggtggtgaaaacaatcacgtcccactgccctctaggagggctcggagccagctcactgctcgaaacagggagtgggtgtcttagccttggccttcagggcagacatgcatcttctataggtcttgggggctgctgtgctgcccacatacatgaggttgtcatgggcaggaaacatgcctctttttcatatgttggggcatctggaaggtctgaggctacatccccagtaacatctttcttctgaagcctcttctatccctgtcaccttggaagtttctgcaacaaaatatcaaacctctcttcctgtttgaagtaaaggtctgtgcaacttttgtggtccttacgtgataaaagcaatcatgataacaataagacttcatttcttctgtctactttaagccaagagtatccttcattttgtttccatttgccattgctgctgttctgatacacacaagcatgcattcaccactgctgccggttcaccttgattcgctcagcaaatctgattattagactctcgagtgttttcattgctgtcaaactcatttgatttgaaataagtttcctgaggccttgaactcaagaggtgttttacttataatattgaatctattcctttttaattttcacattatatattgttatatagtacttgttataaatagaagtacaatgattatattgcagtagaatcttccacctatctgtgggtgatgctgcagtttgtatccatgaaagtgaatgcactggtcagagatcatgtgatcatggatcatgggtttctgagagtcctcagggacaggccatttctccaagtgtggggactcggtgtcccagatgcaaccctgatagaggtgccctgagtctttcatagctaggaggggcatcatagtccttccaaattcactgatcagaaattgtggtggtacagacaccaaatttctttccccagagaatgatggtcactgaggtggagttgctctggacccattttttcttgtgtcatcatcaaatcgcttcttgctcaggtgccctgtgtctcctgggactgagtaaggccagcacacagatgggaattccctgtcttctgagaccttctctctaactgctgccactttcctctccgtgactcctgagacacctggtcctaacagtggacaagctgtgacactgaggctgaacagaacacagtccactgttgtaaatggcgctgcaagaacttgtagcaaaagtgagcagggcttccaatttatactgagaatgaacatgcaacaggagcaaggggcagatgtttctaatgaacaaataggaaggaatagggtttctgctttattgaaatcattctgttgtcttaagtaaagcaggagaaacatttcattgcaattactctaagtcaaaggctagcagctcccaaccaaccagcataactctttgctctgtgatctcggcagcttcagaggactcagaaatcctttctctgcacaaacatccctttgtccattccaagattcaggatcacacactgatcctatcatgaaaacaatgaggtgtgctatagttgctgtggcctcatttttagtgtgttgagcaggaagcattgaagaactttgaaagctttgctcttgagtctagggatgtgctggagccagcttgaatgactcagaagaaccaaataggcatactactcttcccagctcccctttcagtgaagccatgttggctgcttgaagtctgtcatggtgggtatgctggtacaccacaaattgggaaatgctaccagccatgcccccaccttcacagacacccagtatagcagcatatccctggggtattttctgatgtccctgttatgccatttcttgtggggccaaaagggctcagaattcacctcccctctactcctgctctgagaagccatcatctaagtgggcctcaattgtacctatttctattcgacctctaaattctcttgctctgtagctctgtgtctcctacaagcatgccagtctggaacatgacaactattttgaatgtaactaaaggtatcactgaaccagttcattatttgcaaattatctttccttgcatggaatattcagatgctggagtcattgggaacagagatggccaagcagcaactctgggttgtgaaccacatacagccccgctattcttctatgtcaccgacagaccctgaaacaaggactattttgctttggagactaagcagctccccaccagtcaggaatgactctgcttttactttaggctgagaggtcagaaggatcatgccctcagtattctcctctccaagacagagtgtggccactctccatctcagtccctggaagttgtccagagttccctgagaatccctgctctgggacagaatcaccaaggctcatcctcaccagctcccaacaggctccagcagggctttcctgccaggtgcagggcacaggaaatggctctgcctgtctcttagttagagggaggccatgcaatgatgtttgtataagagggactgggattctgggtctccattaaagtatttgataacattttctttgtttttgttttatttggccatctcaccaattaggacagcaatccctttacagttatattgttcttggcacttgggaaggtttttgtggttaagtcacattaagaaattgtgcctttttttcctgttcagatataacccaaggcagtgaaagaaacaacaataattttgaaagcagttacttatgcatcctatgataaaggtgttaagtttcattgcccacatctaactttcagtctagtggaaatgaaaagtcacagttagggggcatgtgagcatgccctgagagaggccgatgccaattgagaagtctgtgccaatccccaatactgtgagattgaaggggagggagagatgacctctctttcagaccatgctcaacaaggagggagagggattttcatccatgggaagctgaggaggagcaaatcccagggtcctctaactcagggtgcgggaacaaatccttggagaggaaaatggtccagttcagctgtcacaggagacaggagaaagcacagtcatctaatccacagtcccctggctgatttgcttccttatgatgctattttgtaccagcatgtcctcatctcccgctgctcctctgcctgtttcagaatcatctcttccgtgtttggtgctcagatcagtggatgtgcattgtacaagctgatcatttcctgtagcagcccctttgctagtcttagctatatccatccttagtttctacattaggtactgctccctccaccattgcttattgccttgtaagaggtttcattttatatatttcaattttactttttattaatagacatttgacttcatcttttgctgatctatacttttggggtaacattgtcattttaggaggatgtgtttgtttatctttagtgattcacattaaataatctctttatacctcaacgtctgtgttttcttactatttaaaaccaaatattattttctttcattcctctccttctattcctctttctttagatggtagtttaagggagaaaaagttaaactataactggagatatttgttaagagtttttcagaatgacggtgggatattaagattttggtaactgaaagcaatagtcagggttagaactagtgttggtatgatgatttagggaagctgctcataacacctgcgggacggcacttgtggaatattctgccggctcactcagcagacacttcccagcggaagaaataatgatgaaacttcacttattggccacaagatggcactatggtccactgggctctggggagtctgggcgagcagtctaggagggaaagggttaagaaaaattagggcttggatcccatattatgcagatgttgcagcagttttcagttattgctaggctacctacagctatgcaagaggcgggaagtccctgtaatctttagtgacatctacagttgaagaatttttgccttcgtatcaggggcgggtgcagaggagcaaatgcctcagaggaacattggaaattgtctgaccaggcaacagctttaacctgcttgagtgatctgggattctgcaagttcataagtcttactgataacatcaccttggctgagattccattggacaccaagtatgtgttctctggagggcaaaaaatattgagaagttctaaaacacctaagtaaacagactactgaaggaaaatgttagtagacacatcaaactgtgctgttagagctgaatataattgactagaagaattatcaaaaatagactataaataagtcactactaaagtatttgtgggcatagaacagtgtttgagtcttctcagggtagattaaggaagaaattcagctattatcctcatgaccttggcttggatgaaaatgcatggactcctcaatttattttcttgtaaaatgttacagaataatattgagcaaacattttatttttctccagcctctatccctctttagcacttacaggtagagcagacacctagacgcaaggttttttagttgggatccattaactgcaggactggagatccacagctgggctttacagggattgcaaaccccacatgcagggaaccccgtgtgtctgcgctgtgcccaactcccctctgtgaggctgccaaaggcggagggccgggtgtcccaggaccccactcacaaagaggggagcaggctgcttgctgggcaaaaaaatcacttcaccaattggccaatctgttgaaagccaaaaagaaatgaaagtctcaattgtgagactgatgaatgcccaatttcccaagttatgaaacggatagcagctcatggttctcagaatgatttcaacagcatatgaagatatttttagagagcttttgtttgtctacagctttccttgatattgatcctcacttgtttttcagcccactcatcacttgagcttattttgtggccaaatttcaatgttgtctatttcagtcactgagcacttctcacattctccaaatcttacacagctatgtgtgttcctgtcttttcttctttttgtgtgattcatttttaaattgggctgtgcagaatacaagcatacatttgtaaatgactcccatcttttatgcaatttagctgtttaatttttagtaatactttttattaaggtataattaatagagagtaaaacacaaatattaatagaaggacatcctggtacattttgacaaatgcatacgccagtgcaatagtaactgaaatgattataaaaaaaatttccgtcactcaagaaagtgtcatcatgctcctttctaatcaatttctatcccagggataaaaacttttctatgtgtatcactgttgagtagctttgtctattcttgagcttcatataatggaatcatatttttattgaattgtttttctccaaaattagtatttctgaagtatattcatatcgttgtatcagtaggtcattcttatgactaatattccattgcataaatatactacaacttgtttatccatgctcctgttgatggatatccatgttactcctgtcttcaactattatgaataaacttgttgtgaacatttttgtggaattcttcctgtggacatatgcattttttttaaagaaatagacttaagagtggaaatactgactcatagtgtagatgtgtgtgctatgcttgcatgtcctcacaaaatctcatgttgaaacttgtcaaggtaatggtattgggaggtgggacagctatgactagggtcatgagggatctgccctcagaaacagatcaatgccctttattgtgggagtgaattaattatcttgggaatggtcttctgataaaaaggatgaattcagtcattttctctgacttcggtgcttgcttccccttccttctgccttggataacagcaggaggccctcagcagttattgcccttctatcttggacttctcagtctccagatctataagccaaataaaactattgtctttataaattgcccattccatggtatttctctatagcagtaggaaagaaattgaaagaaaatatggtacctgagagtgaggctgttgctataatacctgaaaatgtagaagcagctttggttaatgggaagtggctaatggatagaggctgaaagaattgggaggagcagactagcaaaagtctagattcctgaaaacagagcataaagggcaattctggtgaaggctcagggggaaatgaggaacaaggtattgaaaatcgaagtaaatgccatccttgttgtaagtagcaaaaaccttggcaaaattgtgtcctgttctagaactttatggaatataaaaattatgagccatttgctagtatatctgctgaaagaaatatctaagaggcaaagcattcaggctactgtgtgactacttttagccaccaggaaatttaacccagcaagaagggagccatgggaatagattttgcaaaccagcacagatggtgactctacctccctctgctgtcctgtctcccataagccaaactctgtgctgtgagctgttaaagtccaagaattatttctggggaatctgtactcttaataatttacagacaacacaggtctgctttggatctgatcagacagactaaatcttggggactgtaccagtggccactgagaaaaggggctcggaatgttgtcttggatagaaaaatataataagaaacattggtgtgaatctagcatcagaaagatgacgtgaggacagcaaggaagagctggaaactgaggtttactcacaggctcctcaccctccgctgatgggcaggtgtgtgagctccagcatggagcaccacagcactaggtgggagaacggtgatagggtgatggggcagcctgtgagctggggcagtgtaggcagaggaggaactgtatcaccacagaaacttctgccttcacacatccctccagctaggcaggacaggtagagagtccagtgtcctggagcactagacctaaggaaggctgcatggggaggacaaaggacagtgacatcacaggatacccctcccatcaggaaaatcaaggcccagaactcactcggctcttccccaggagaaccaagccctgaatcagatgcagtgcttcctgtccctctgtgccatgggccccgggctcctctgctgggcactgctttgtctcctgggagcaggtgagtcctgggcacaggacagcagccccattctcagctttcccacccctgtgtcctccactttaccttggggaggacctccaggctgtccctgtgctcatcctccatctgcttttcccacaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcagcttggcacagcccatcagagtcactgacgttctgtatataaacttcctgccttagctttgccttgagagctgcaggccccacccagatttcactccttcaagggaagcttttagttgtttggaaggcatgtcttgtgtcctactgagggcagagctctcccaaccaataaagcccaagtttcctgtgtcctgagtgtgcccacttctgtgctgcatcttcttgcagcttgtcacctcagtacaagagtgactgctgagccccagatgtgtgcttgattatttgcatttcttacatagcttaatgcctttcaacaatcttgcacatcaaacattcttattcttcctttacagatagaaggctcagggacattgagtcattttccccaatgtctcttggcttgtaaggatcagaagtaggaaacaaactagtccatccattttccacctacccccctgctccatcatcatcttctgcatcctggtcagtaaatcagagccctcacactgccgtctagtgaccagcagggccgcagtagaggctgaaatgtcttcaggggtcattactatgtccttttcattagctcctttgaggaatgttaaatttcacacattttaacaatcatttatatgcattccctttgtctttccccagtctgcagcttatattttcatttttatggagtttttggtgcacaagagcttaatttaatgcaacaaaaactaaaaacaattttgtttgtgtgtagacaaaaaccactttttcatataaatgtctaagcatatttttctcaacttattctactaaaatttaagtttggattttcaccactaagaataaatgtacctgaaatacatctcatgtaagaaataagatacagacctaggaatgggagggaaggacatatattcagtgaagaaacaatagcttgtcaaaaagagccctaagtggacacctggagctgacggtggagaggtaggtggagggcaaatgagcatgaactttgtcagtctattgtcttgtagaagaaagacagccaggagcagagaccatatgggtgaaggtttatgacttgactgtaggttgaaggttgcagcaggtagagggagaattgcaggcagagggcagagtcactggctggcaggggcagtggcatcatcagttgactctactgacatctaggatttatgtccccaacacacaagctgaaaaacctccccacaatttccccatttttccctgaccctaccatgaccaccagactcctcagtggtgtggccttttgcctacttggggcaggtaagatctttaaagccttttccttggctcaccacatcccagcttaagcctttacctcaggtctccattattggggtccctccttgggcactcatcttccttctatcataaacctcacagaagctgggacaatcaaatccttaagataccagagaacaaaggcagtacatgaagtggcacggagatgcctgagactgtcatccatgactacatgtgtaggtgttaataggagctgaacctggtgtacagctgatctgtcccagcccgcaatacagagaaatccctgagggtctgtgactttctctcaaagccaaatatgtggcctttgtgtcagcctctcccagacctctgtgccctcttgcaccagcagtcaccccacagccaccttcctctgcacacaatgttcagtggaagatataggtggccttgtcttcacgagaccatgttctaggcagtggaagacgttttcccataggagtctccccaacactgcccaggctggggccctcagatttctgagcatccctgtgcatgggaaactctgccctgtgttgagcttctctcccaggccagtctcagctggacgagggaacgcacatcacagtgatgtgagcagttgccgcctctctcccaggcccctcctccagctctggcctcagaagtcctcttcttcacttgctctcagaaaggaaagttcatttgaaattgtatatttgcagacagcattgacaacttttccccgtcggccttcacaactccatcttccccacaccatgctcatgtcagtcctcagcctcctccacatgatgtctgctcccagctgtcctctccctctgcaccttcacctccacgtcaaccacagatgcctcagttcaggacattcctcatgcatcatgctcctcccaccaaaggcctttccactccatgctgtattctctgtgtcaacacaagtctcttcttctttgttcttgctccaactgtcagtttatctacaaccatctctagggagacactccttcaacagttttcctaggctgcacctccttattgtaaatgctcacagcttataatatgtattaaaattcatagatttagcaccatagtcattttccatgactttgtgtgactatttaattgacactactcttgcattctagactgtaacatgcatcattttacaaattgtggatgttttgttccccattttattgtcaggaccaacagcagttccaatcttgaaactggccaatcttgaaaaatgaagagcagatattgaaaggccgtctgagtacccacttagatgtctggacgcattaaatcggaacctctatcccttcatctcctaggatcaaatgagtcctggaaacagatgagaaatccctgtcatggataagtaactggatccaagcctttctgcacgactgaatttcctatctgccctatcgccttcctgcctaatctcctccttcaatctccttccctcacaggtgtcctggatttgggagtctcacagacacagcgcacctaatcactctgagagagtgatcagaaacataatgtcaaacactgacattaaaaggtcatggagaagaaaacaaatggcttccccatgctcttatggagagttttcccaaggcacaaatatctctttgggtggctttgaggtcatggtgcctgacacactgagcgatattatgggtgtccatttccatgaattggtgggcaatgtcagagacacagagttcatggtcaccagcttcctccagcccacacctgattttggtgcagggcgctgagcagagacctttgcttgttaccctcctttgccagttaggaaaggctgattgagaggcagaggctccatttacagagcagggctatgtgttagtccctgaagaattgtgagagccattctgggtggaaataatcaaatatacaatccccaagaatggcccacggatagacagaagtcccaattttgccagaatgatttgcatctatgctttgaagacaaatgcagttttatctctttaggcaataaagaccaaaaatagactagttattttaaataattgaaccttaaacagaccaaagtcagaacatcttccctagggacagcattttcttccacccactcactaaagctgtatttgagaaagcagtgtgctgttgataaacgctggaatatcgttacaatcgacattgtaataatactgctacttggatcagaaacaaagagcatttctaaagcttgaacaatgtaaaactggaaacgagctctcactgagtttggaaatgcaggcactagagggtgctcatttctcttccttttccaatcgggggctattcaaaggctgttctagaacaaggggtgagatcctccacttccccgtggtgatcaggctttcacaggtagaagccttattagttcataatcagccaagctgacctcaccatcaaatgtatcgacctcgatgctcaccctcctcagcagtcagagactggctgtgttcaccaggagctcgtgtgtttttacggagcacactttctcctcggtttattaaaaacaaatgagcctttatacggggttccataaacagaagctttctgtactttgcccatttagacactgcaaattctgatgcctgatgaaaagtgtaaacttaaagcttgcatgtcgttaagattttttaataaccaatttaaataatatatataatgaaaatgtcaataatgctctcgaatccaatcccatgttccattggtaaccaatattaacgctctggtgtgcttcttttcacccctcttttctgtgttcatgcacacctttctacccaagtacacctacagaaaatgggttcacctgtacactttaactgccaaatgtgtactcttttctgtatatcttggtctttattgttccagattggttgatatagatctaacttgctcctattatctgcttcatattgcataatgagggtagacaggtacattcatgctgtattgtctgtttcctaaattctgccagatcttttctaaagtgaccaaatggcatctttacgcttccaggttctcctcaccccagcacccagttgatgattccagcttttccatcactcatagtcctggcaggtctgagagctccatttggtttctcctgcatgaggagacagggagggataaaaggatagacctttatcaaacctaccagagactacatggtatctcagttcatcctcataaagcattgaggggaatgctagtcttgttttatagatgagtctagatgaggctagagtccaggaaatcaataaatagccttgcccatggtctcagagctaataaatggtggaggcagatgaagggcagtcggcttgcttccatgtggaattgatagaggggtcactggagtttgagggaggggaagtctagaaccatctggcgttgtcttcagatcggacaccagggttgagacagtctgtgtaccctatagcaccgcaggtacaagcatcatggtgttggcagtggggagatactagagtgggtaagtgattagtggcctggaactggaagatctgagctttgacaaaattattcccatcacaacatgtagcagagacactgatgtggataaactaggtcagggagctgtgtgaggagctgttgttaaaataagggagggaggagaagcaactaagtggtcacttcctaacatgaaatgtagaggaaaccaatattaactagaatccatctgattttagtcagttttcctttgtaagtatttggaaggtgggataatttattttcaaggttaagtaaacatctatacatctcctttatcttttgaagactggtggcgaagcgaaaaatggcacggccaatggagtcagagtttgtttaataaatatctcagagttcaaagagagactctcatgggccagaaattggtaaatgttcctgcattctaaaattaggaggatcttattttctttgaatcaacagagaaggaagcacaggcagtggggaggaacagttgggaacacggcagagtggccgcaggatgtcaaagacaaaggacatgtaatatcaaattctaagctgtgaagctgtgatgcaaccctccaccttctcctaatggattttttaggtctcagcgcagatgcacagctgagggagtaatttctttggaaatgaaggacaaatagctgtgttaaatattaataacaagtccacattacaaagcacgcctggaaatggaaacaagattatttctaaggccttttctactctaagagtctctaacttggtggcaaggtgagaggtgaggttggggtgggtgttgatccacacgcgatgagtaccatgaggctctaccatgaagcatgtagttctcagtgtgaatcagagccctaagaagaataatgccctttactttgttttgtcctgtgccatcccaaacccactccacccataattaagcagccatggaaatgagggtagccagaaggaatcaaaccctgctgcttggttcagtagacacagggacctgggaggagggtgttggctgggtcaaggagaagatgatgagctcagaaaatagacaaggagaaaccccagtggaaagcttgtaaaactctggatgaatcacaagatatgttattagagctcctttttattactaaattttatttattactaaattaatggcaggaaccctgcacaaagggatattccctatgaaagatggcatctcaaataaaaacagagcattcttccttaccctaaagtctgccctttctccccaagtccctcatgcatcaggccacctttgtgcccacagatcatgggcagcgctgggtggccatcatcatccacacagagagggcagtcagcagcatgagctggttctgcctgatatggtctcaccctaggcatggaaagcaagagacctgcgttgagctgaaggtgctcagctgggtttgtcaggagtcccatctgtcagtgaattgacaagaaacagagcaaaacgactcctgcaatgttgagaagcctgcacctaggatctggaaacttgataacagagaaaaccaatatagacaaaggattttaaacaggattatggtcaattaagcaaattagaaaaggatacttgaaggagtatttgggatacaggaatcaaaaacaccaggaagacatgagaagtttccctaagagtctagactacagcactgtgtagataactaacatcagaatattaattatattattgaagaattaaaatttacattgaattacaaactctttacaaaaggtcatgaaaatcttgtagacttgtttcaattcagacaaatgtgttcttctcattctcagctgttcactggtgcatttatcttgaatttgaccatctggggaatggcgtggcctctcctgactggaaggctctggggcccaggcagggagaatgatgtctcagaatgactcccttgagagtcctgttccccttttatcaatgcacagacccagaagacccctccgtcctgcagcccctgccatgagcctcgggctcctgtgctgtgcggccttttctctcctgtgggcaggtgggtcctgggcagggcccttgcgtggatttcaaggcccatcccctttccactggggctgcagcatcagttttgttcttctctgcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagttactccacagcgctacaaggttgtctcctctctgcacataaaggcagggaggctctgccctccaccccgacctgagactcagggatgacctgggcagagtattctgcaacgggaaccttggaacccgaagtggccccaagtggcccagacagtatgagcctcgctctgtgccaggtgcctctgtaggcatctcagccaggcctggactggtcccaggtcctcatatgtctcctttgttgctctctcctacaagctctacttttggggttggggccagggcttccccagctcctacttttctactcatcatcctgagtccaaggcccccaggatgaaacaggatttgtatttcagatccatctagactcctgtctctccctggtgaccatgttgcttcctctctagggtttcccccagcccccaccctcctgtggcccacctttcccacctccgcagtcatcctccaccccccacttccctgcccctctctactgcagccatgaggggagcacctctctgtgactccttccttcccgtcacagagacttcaaaggccattttctttgccctgggccagagccttcctttctctagtggccagctccttcctgtgcttcagatctcagtatgatcagcccctctgcgggaagcactccctcccctcccaggtaagatcaactttcctctcataagctctcaatgaatcatatgtctgttagcaacctttagcacagttgggctttctcagatgcttgtctgattatttttgtgctccacccaatttttttttttttaagacacagtctcactccgtcaccaggctggagtgcagtggcatgatctctgctcactgcaacctctgatactctgattcaagtgattctcctgcctcagcctcccgagtagctgggattacagacatgtgccaccacgcccagctaattcttgtttgtatttttagtagagatggggttttaccatgttggccaggatggtctcgatctcctggcctcatgatctgcccttctcggcctcccaaagtgtggggatacaggcgttagcagcacgcctggcctctccacccaatttttaagcccatgggagctaagactgtgcctgctgtatttaccaacatcggtgcctggcatgtggggagacccatttcacagagaatagatgagtgaatgacaggctgagtgagtgatgagtgggtggacgaacaaatagcaggaacacgctacatctactgtaacctgccagagatctagcattaagtacaagaaagcccacctctttgattgctgggctcaggtcggtcttggaaattgatggggaatcactatcatggcggccacacctggttcaaggcttcctcttgtggctgcagcacctgacctcctccaggtctctgtgctctccttcaggatctttccccacaacaaatctagacagatcagagatccacttcaagaattccatccttaaaggttgttccttgaaaccacttctggtaagaaaatctccattaggtttgcatcaataaaacagagccactacaggtttgtgagtgtaaaagatttatgatcagaattagactttatgcatatgtgggaggagctgaggaagacaaggtcttgaggagagaagtcagaaggtgagggagccagtcagtagccagggctcctggagctcgggcaggacaggctggagtggcagggacatgagaggatcagagcatgccaggccatgcagtgggaccttgagccgggagcacaggaaaaggccgaggaaacctgcttctggggaagctgttccctctgtgtgggggccatgctgcgggtatagtgccaaacactgggggcagcctggctgctgttgggcagcatttggcaagatgaactggacacagggtgcagaaggaacaggacttcctaggtctgttggatgcctctgtatctgctggtcactgactctcactctctcaccacaatgacctgccaattgttatagtgactgttttgtatctgtcttctaaatgttacaaaatgtatccttgaccatctctaacccagaatgataaatggcattctgggaaagtcagactcttacatttgcaaagttgacttaacacaatccagcacagtatggattctcccagattaaggcatcagatcacacaactgactcaacctgccacggtccgtggactcctctccgggggacacctgtgctgcccaagtgaatgtggacacaatttgtatgtagatgttccagacactggctactaaattttcttttaatcctgtgcctgaaatctcgctccacccagaggcagggctctgcctcctgcttctgtctccttcctgagcttctatcctgatggagttggatggacatcagacgcctggtcagagtgcagtgacctgtggagacagtaggagggaagctcacatcttgctgccttcctccatccagttcttttataaccaaagcaagtgttctggtctcccttttgactgtgcagtatgagaaatgtgcttcatgaatttgtagctgatcagctcaatgatttgatggccaacctaaagtgaaatcctcagatctgcagaaattgccctgcatttctgtgaagatggcaagaatacagtgtgctagagttgccttctctccaagtagagacctggcccccaaacaggatggagcagagggggccaaagagcccaaaacatgtctcagattgttgaaaggcaatttcccaggacaatcctactgatgacatttcatcccttgtattacacacttggccacccttccccccagatcagctgagtacccaggatatcacacatcccagcatcttctaacgaggaaaaatacttcacgtaccagcctccttcctgcaccacattgactaaccctggaaacttagcctttccagaaaaaagctctgtcttctcttggcccagtctagcctggtaggtttaattcatgatttatgtgaccttttaatttactcaaaggagaacgtatgatttcagggtaaagaatattcattttatttttataagttggacctaaacagtaaactgagtacttttcttccatcagcgtcttaaattagacaacggtaaaacaaatctttgatgctagaacttcagatcctagtgtttttcacatggaagttcccagttacccagtctagggcatggaatagatgagcattaataagtcactgtatgcctgagatggttttctatgggcatcttttctgaattacggttaacaagggtgggaaatgatcccagaagaaaggcatgagggcagttcttgagggaacccatgtgatgggacagtctcattgggcacgtgtgactgggggaatggaggaagctggggcatgattgggatggcacaggggaccctgacttgcgggaaagacaatgagctcaaccctttgtgcccctatgttaggggcgctgttgttgcatcctacaggacatgcccagcaggcaggggagcggctgtaggatgagaagatgaactcagagatgcagtgtgaggtctccaggcacagacggctctggagcacaaaccaatgagccatgaattgatgttgttaaaacggaggttataaatatttaaagtgtcacccaagtgtgttctaatagaaatgctgtgaccctgaggtcctgaggattgagagaggaagtgatgtcactgtgggaactgccctgtggagacaaggacatccctcatcctccgctcctgctcacagtgacactgatctggtaaagcccccatcctggtctgacactgtcatgggtaccagtctcctatgctgggtggtcctgggtttcctagggacaggtgagtcctcaaaacacaaagtagtttcatattttttctgtatgtaggtgtgtgtgtgtatgcatgtgtgtctgtgtgtgtgtgtgtgtgtgtgtgtgtgtgtgagatgactacaaatgttttccttattctgttgccagattctgtttccacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcttagccacagcatggcacagtcgcctccttcctgttcacaaacctcatccttctctctctttgcagctcccagagatcattaacagaggcctctctttgctcctcacttttcctgggaaagaggtagatttggacctcggttgtcctttgggtggaaagagaccacagattcattcctgaaacacagtgactgcaaatgtaagtggtgaaaacaatcacgtcccactgcactctaggagggctcggagccagctcactgctccaaacaaggagtgggtgtcttagccttggccttcagagcagacatgcatcttctataggtcttggaggctgctgtgttgcccacatacatgaggttgtcataggcaggaaacatgcctcttcttcatatgttggggcatctggaaggtctgaggctacatccccgagaagatctttcttctgaagcctcttctatccctgtcaccttggaagttttctgccacaaaatatcaaacctctcttcctgtttgaagtaaaggtctttgcaaatttgtggtccttacttgataaatacaatcatggtaacaataacacttcatttcttctgcctactttaagccaagagtatcctttattttatttccatttgccattgctgctgtcctgatagacagaagcatgcatcaccaccgctgccacttcaccttgattcactcaggaaatctgattttcagactctgagtgttttgattgttgtccaactcatttgatttgaaataattctcccaaggcctttaactcaaaaagtgttttatttataatattgaatctattcctttttattatattttttcataatatatagtgttatatagcacttgttagaaatagaagtacaatgattatattgcaatagaatcttccatctgtctgtgggtgatgctgcagtttgtatctatgaaatggaatgcactggtcagagctgatgtgattatgcattatgggtttcggggagtcctcagcgacagaccacttctccaagtctgggactcagtgtcccagatgcaaccctgatagaggtgccctgaatctttcatagctaggaggggcatcatagtccttccaaattcactgatcagaaattatggtgtggtacagacaccaaatttctttccccagagaatgatggtcactggcagggaattgctcttgacccattttttcttgtgtcgtcatcaaatgactccttgctcagccgccctgtgtcttctgggactgagtaaggccagcacacagatgggaattccctgtcttctgagaccttctaactgctgccactttcctccatgtgactgctgagacaactggtcctaacagtggacaagctctgacactgaggctgaacagaccacagtccactgttgtaaatggtgctgcaagaacatgtaacaaaagtgagcagggcttccaatttatagagagaatgaacatgcaagaggagcaaagggtagatggtactaacgaacaaatagggaggaatgtggtttctgttctaatgaaatcattctgttgtcttaagttaagcaggagaaacatttcattgcaattacttcaagtcaaaggctagcggctccccaaccagccagcataactctttgctctgtgatctcagcagcttcagaggactcagaaatcctttctctgcacaaacatcccgttgtccattccaagacccaggatcacacactctgatcttatcatgaaaataatgaggtatgctatagttgctgtggcctcattttagtatgtttagtaggaagcattgaagaagtttgaagcttttctctttagtctatggcttgtatgactcaaaagaagtaaataggcatacttttcccagctccctgttcagtgaagccatgctgggagcttgaaatctgccatggtgggtatgttggtacacagaaattaggaaatgctaccagccatgcccccaccttcacagacacacagtttatcagcacattactggggtattttctgatgtccctcttatgccatttctgagctaggccaatatagctcagaatttatttccccactactcttgttcttagaacccatcacctaaggggccgtcaattgttcctatttccattcaactcccaaattctcttgcactgtagctctgtgtttccttcaagaatgccagtctggaacatgacaactattttgaatgtacctaaaggtatcactgaaccagttcattatttacaaattatctttcctcacatggaatattcagatgctggagtcattgggaacagagatggccaagcagcaactctgggttgtgaaccacatagagccccgctattcttctatgtcactgacagaccctgaaacaaggactattttgctttagaaactaagcagctccacaccagtcaggaatgactctgcttttactttaggctgagagatcagaaggatcacatcctcagtattctcctctcctggactgagtgtggccactctccatctcagtccctggaagttgtccagagttccctgagaatccctgctctggggcagaatcaccaaggctcatcctcaccagctccccacaggctccagcagggctttcctgccaggtgtagggcacaggaatggctctgtctgtctctcaggtagagggaggccaaacagtgatgtttgtataagagggactgggtttctgtgtctccattaaagtatttgacaatattttctttgttttttttttttttttggtttatttttccatctcgccaatgaggagagcaatcccttggtagttatattgtttttggcacttgggaaggtttttgtggttaagtcacattaagaaattgtgcctttttttcctgttcagctgtaacccaaggcagtgaaagaaacagcaataattttgaaagcagttacttgtgtatcttatgataaaggtgttaagtttcattgcccacatctaactttcagtctagtggaaatgaaaaggcacagttagggggcatgtgagcatgccatgagagaggtcaatgccaattgagaagtctgtgccaatccccagtactgtgggattgaaggggagggagagatgacctctccttcagaccatggtcaacaaggaaggagagggagttcatccatgggaacctgaaaagcagcaaatcccaggggcatctaacttcaggtgcaggagcaaatccttggagaggaaaatggtccagttcagctgtcacgggagacaggagaaagcaaagtcatctaatccacagtcccctggctgatttgcttccttatgatactattttgcatcagcgtgtcctcatctcccgctgctcctctgcctcttccagtgtcatctcttccctgtttgctgctcagatcagtggatgtgcattgtacaaggtgatcatttcctatagcagtccctttgctactcttagttatatccatccttattttctgcattaggtactgctccctccaccattgcttattgtcttgtaacaggtctcgttttatatatttcaattttactttttattaatagacatttgacttcatcttttgctgatctatacttttggggtaacattgtcatttttggaggatgtttttgtttatctttagtgattcagattaaataatctctttatacttcaacgtctgtgtcttcttactatttaaaaccaaatattatttcctttcattcctctcattctgttcctctttctttagatggtagttttaagggagaaaaagtttggctataactgaagctatgtgataagagttattcagaatgagggtgggatatcaagattggtaactcaaagcaataattagggttagaactaatgtaggacttagggtttagggaagctgctcataaaactgcgggatggcacctctggaatattctggcagctcactctgcagacacttcccagcattccttgggccattacagaattaaacaatgatgaagcttcacttattggccacaagatggcagtgtggtccactgcgaatgtaaagggctctgggcagtctgggggagcagcctaggagggaaaaggttaagaaaaattagggtttgtattcaatattatgcagatgttgcaggagttttcagttattgctaggctacctacagctatgcaagaggcaggaagtccctctaatctttaatcagatctacagttgaagaattttggccaggcagccttggtgtcggggcatgtgcagacagaggagcaactgcctcagaggaaaagggaaaagtgagaggcaggctgtgccctgagcccagtgggtctctgctgcacctcatcttccctgcaggtctggccaggcaacagctttaacctgcttgagtgatctgggattctccaagttcataagtcttactgataacatcaacttggctgaggttccattggaaatcaagcacatgttctctggaggacaaaaagtattgacaaaaatttctgaaacacctcagtaaacaaactattgaaggaaaatattagtagatgcaccaaactgtgccgttagagatgaagataatagactagtagaattttacaaaggagactataaataagtctctactaagtatttgtgggcatcaagcagtgtctgagtcctctcagggtagattaaggaaggaattcagctattatcatgactttggcttggatgaaaatccatgaagtcctcaattgattttcttgtaaaatattacagaataatattgagcaaacattttatttttctccagcctgtatccctctttagcactaacaggtaaagcagacacctagaggcacggtttctttagttgggatccattaactgtaggactgggaggtccatagctgggcttcacagggagttcaaaccccacgtgcagggaactccgtgtgtctgtgctgtgcccaactcccgtctgtgaggctgaaaagggggagtgccgggtctcccagtaccccactcacaaagtggggagcaggctgcttgctgggcaaaaaaatcaattcaaaaattggccaatctgttcaaagccaaaatgaaaggaaagtctgaattgtgagactgatgaatgcccaatttcccaagttatgaaatttgtagcagctcatggttctcagaatgatttcaatagcatatgaagatattgtaaaaagcttttgtttgtctacagctttccttgattttgatcctagttgtttttcggcccactcatcagttgagcttattttgatgccaaatttcaatgttgccacttcagtcaccaagcacttctcacattctccataacttacacagatatgtgtgttcctgtcttttcttatttttgtgtgattcatttttaaattgggctgtgcagaatacaagcatacatttgtaagtgaatcccatattttatgatttagctgtttactttttagtaatactttttattaaagtataatagagagtaaaacagaaatattaatacaaggacatcctggtacattttgacaaatgcatatgccagtgcaatagtaactgaaatgattataaaaaaaattctgtcatgcaggaaagtgtcgtcatgctcctttccaatcaatttctatcccagagataaaaattgtatttatttatttatttagagacaagagtctcactctgtcacccaggctggagtgcagtggtgtgatctcagctcactgcaagctctgcctccccggttcacgccactctcctgcctcagcctttggagtagatgggactatagatgcttgccaccacacccggctaattgtttgtatttttagcagagacggggtttcatcgtgttagtcaggatggtctcgatctcctgaccttgaaatctgcccgcctcagcctcccaaatttttgggattacaggcatgagccaccgcgcctggccaaaacttttcttatttttatcaccactgactagcttggtctattcttgaactccatataaatggaatcatataacattttattgagttattttcctccaaaattagtatttctgaagtttattcatattgttgtatcagtaggtcattttttcttatgactaatattccattgcataactataccacaacttgtttatccatgctcccgttgatggatatccacattactcctgtcttcaactattatgaatacagttgttgtgaacattcttgtggaactctttcttgtggacatatacattctttttttttattttattttaggtataaacttaagagtggaaatactgacttacagtgtagatgtgtgtgctatgcttgcgtgtcctcacaaaagctcatgttgaaatttgtcattgtaatggtattgggaggtgggacagctatgactaggtcatgagggatctgccctcagaaagagatcaatgccgttattgtgggagtgaattagttgtcttgggaatggtcttctgataaaaagtataaattcagccactttctctgtcttgggtgcttgcttccccttccttctgccttggataacagcaggaggccctcagccgctatggcccattgatcttggacttcccagtctccagatctataagccaaataaatgccttgtctttataaattacccagtctgtggtatttctctatagcagtaggaaataaatggaaagaaaacatggtgctgagagtgacgctgttgctgtaacaagtacctgaaaatgtagaaacagctttagttaatgggaaatggctaatggatagaggttggaagaattcagagaagcagactagcaaaagcctagattgctgaaaacagagcattaagggcatttctggtgaaagctcagggggaaatgaggaacaaggtatcagaaattgaagtaaatgccatccttctcataagtagcaaaaaccttggcaacattgtgtcctgttctaggactttatggaatataaaattatgagccattagctaggatatctgctgaaagaaatatctaagctgcaaagcattcaggccactgtgtgactacttttaggcaccaggcaatttaacccagcaagaaggcagccaagggaatagattttgcaaaccagcacagatggtgacactacctccctctgctgtcctgtctcccataagccaaactcactctgaagttagagaaaagaggagacagttaacatgatacactggagtcagcctgtgaaggcagggtggatctggagggattaacataaactttccagagcactacatataggatggccttgagggtgttgagtccaaagctggctaggtctgtggtgtgagctgataaggccctagatttatttctggggaatctgcactcttaataatttacagacaacacaggtctgctttggatctgatcagatggactaaatcttggggcctctgtaccgctggccactcaggaaatgggttgggaatgttgcctgggacaggaaaatatagtaagaaaccttggtgtgaatctagcttcagaaagatgatgtgaggagagcaaggaagagctggaaactgatggtttaatcacaggctcctcaccatctgctgataggcaggtgtgcgagctccagcatggagcaccgcagcactaggtcagaggagggtgatagggtgatggggcagcctgtgagctggggcagttaggcagaggagcaactgtatcaccacagaagcttctgccttcacccatccctccagctcggcaggacaggtagagagtccagtgtccgtggagcactagacctaaggaaggctgcatagggaagacacaagacagtgacatcacagcatacccctcccatcaggaaaatcaaggcccagaactcactcagctctttcccaggaggaccaagccctgaatcaggtgcagtgctgcctgccccactgtgccatgggccccgggctcctctgctgggtgctgctttgtcccctaggagaaggtgagtcccgggcacaggacagctgctccattctcagctttcccacccctgtgtcctccactttaccttggggaggacctccaggctgtctccagtgctcattatacatctgcttttcccacaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcagcttggcacagcccagcagagtcactgacattctgtatataaacttccgccttagctttgacttgagaactgcaggccccacccaggtttcactccttcaagggaagcttttagttgtttggaaggcatgtcttgtgtcctactgagggcagacctttcccaaccaatagagcccaggtttcctgtgccctgagtgtgcctgcttctgtgctgcaacttcttgtagtttgtcacttcctggataacttcagtagaagagtgactgttgagccccagatacgtgctagattcttcgtatttgttacatagcttaagggctttccacactcttgcacatcaaacatttctattcttcctttatagatagaaggctcagggacattgagtcattttccccagtgtctcttggcttgtaaggatcagaagtaggaaacaaactagtccatccattttccacctacccccctgctccatcatcaccttctgcatcctggtcagtaagtcagagccctcgcactgccctctagtgaccagcagggctgcagtagacgctcagatgccttcaggggtcattactatggcctcttcattagcaactttgaggaatgttaaatttaacactttttaaaaatcatttatatgcattccctttgtctttccccagtctgcagcttatgttttcacttttatggtgtttttttgatgcacaagagtttaatttaatgcaacaaaaactaaaatcaattttgtttgtgtgtagacaaaaaccgctttcttatataaatgtctaagcgtagttttatcaatttattctagtaaaatttaagcttggattttcaccactaagaataaatgtacctgaagtatatcttatgtaagaaataagatagagacctaggaatgggagggaaggacatatgttcagtgaagaagtaatagcctgtcaaagagagccctaaagtagacccccagagctgatggtggagaggtaagtggagggcaaatgatcatgaaccttgtccgtttgttaccttgtagaagaaaggcagccaggagtggagaccacatgggtgaaggtttatgacttgactgtaggttgaaggtggcagcaggtagagggaggactagcaggcagagggcagagtcactggctggcaggggcagtggcatcatcagttgactctactgacatccaggaattatgttcccaatgcgcaagttgaaaaactccccacaatttgcctattattccttgaccctgccatgaccaccagactcctcaatggtttggccgtctgccccctgagggcaggtgagtcccctaaagccttttccttggctcaccacatcccagcctaagcctttacctcaagtctacattattggggtccctctttgggcactcaacttccttctatcatagacttcacagaagctgggacaaccagatcccaagataccagagaacaaaggcaggacgtgaagtgacatggagatgcctgagactgccatccatgactacatgtgtaggtgttaataggagccaaggctggtgcacagctgatccgtcccagcacacactatacagaatccctgagggtctgtgactttttctcaaagccaaatatgtggccttggtgtcagacagcctctcccagacctctgtgcccccttgcaccagctttcaccccacagccaccttcctctgcacacaaagctcagtggtagatatagttggccttgtcttcatgagattttgatccaggcagtggaagacattgtcccataggagtttccccaacactgcccaggctgggactctcagatttctgagcagccctgtgcaagggaaactctgccctgtgctgagcttctctcccagggcagtctcagctggacaagggaatgcacatcacggtgatgtgagcagatgcagcctctcttccaggctcctcctccagctctggcctcagaagtcctcttcctcagttgctctcagaaaggaaagttgatttcaaaattgtatatttgcagacagcactgacaacacaggtctatgttcttttccctgtcagccttcacaactctatcttccccacaccatgctcatgtcagtcctcagcctcctccaagtgatgtctgctcctagctatcctctcatcactctgcaccctcacctccatgtcaaccacagacgcctgagttcaggccattcctcatgcatcatgctcctcccaccaaaggcctttgcactccacactgtattctctgtatcaacacgagtctcttctttttgttctttctccaaatctcagtttaactaccaccatctctagggagacactccttcaacagttttcctaggctgcacctccctattgtaaatgctcacagcttataatatgcattaatattcatagttttagcaccatagtcatttccctgactttgtgtggctatttcacacttctcttgcattctagactgtaaaatgcatcattgtagaaattgtggatgttttgttccccattttattgtcagtaccaacagcggttccaggtgccagtgaccagtcttgaaagaataaagaagagatattgaaaggccctctgagttcccacagactattccagaagtctggatgcattaaatgggaacctctatcccttcatctcctaggattaaatgagtcctggaaacagatgagaaatccctgtcatgcatgagtaactggatcccaagcctttctgcacgactgaacttcctcactgcccatcgccctcctggcttgtctcctccttcaatctccttccctcacaggtgtcctggatttgggagtctcacagacacagggcacctaatcactctgagagagtgatcagaaacataatgtcaaacactggcattaaaaggtgatggagaagaaaacaaatgccttccccattctcttaggcaaagttttcccaaggcacaaatatctttttgggtggctttgaggccatggtgcctgacacactgagctatattatgggtgttcatttccatgaattggtgggcaatgccagagacacagacctcatggtcaccagcttcctccagcccacacctgattttggtgcagggcgctgaacagagacctttgcttgttaccctcctttgccagttaggaaaggctgattgtgaggcagaggctccatttacagagcagggctatgtgttagtccctgaagaattgtgagagccattctgggtggaaataatcaaatatataatcaccaaggatggcccacggatagacagaagccccaattttgccagaatgatttgcatctatgctttaaagacaaatgcagttttatctctttaggcaataaagaccaaaaatagactagctattttaaataattgaaccttaaacagaccaaagtcagaacatcttccctagggacagcattttcttccacccactcactaaagctgtatttgagaaagctgtgtgctgttgataaacactgcaatatcgttacaatcgacatcataataatactgctacttggatcagaaacaaagagcatttctaaagcttgaacaatgtataactggaaacgagctctcactgagtttggaaatgcaggcactagagggtgctcatttctcttccttttccaatcagggggctattcaaaggctgttctagaacaaggggtgagatcctccacttccccgtggtgatcaggctttcagaggtagaagccttattagttcataatcagccgaactgacctcaccatcaaatgtatcgacctggatgctcaccctcctcagcagtcagagactgtgttcaccaggagcttgtgcgcttttacggagcacattttatcctcggtttattcggaaacatgggcctttatagggggttccataaacagaagctttctatattttgtccatttagacactacaaagtctgacaccagatgagaggtgttgcttaaagcttgtatgtggtgaagattttttaacaaataatatataaagaaaatgtcaataatgctctcaaatccaatcccaacttccatcggtaaccaatactaaagctctggtgtgctttgcacctctcttttctgtgttcatgcacacctttctacccaagtacatctacagaaaatgggttcacctgtacactttaccggccacatgcatactcttttctgttaatataccctggtctttattgttccagattgatcgatacacatctaacttgctctatttgctgcttcatattgcataatgagggtagacaggtacattcgtgctgtcatctgattcccaaattctgccagatcttttctaaagtgactgagtggtctatttatgcttccaagttctcctcaccccagcacccagttgatgattccagcttttccatcactcatggtcctagcaggtctgagagctctatcagttctcctgcatgaggaggcagggaaggataaaaggacagacctttatcaaacctaccagaaactacacagtatctcagttcatcctcataaagcattaaggggaatgtttgtcttgttttatagatgagtctagatgaggttagagtctaggaaagttaatgaatggccttgcccatggtctcagagctaataaatgttggaggcagatgaaggacagttttcttgcttctgtgtggagttgatagaggggtcactggattttgagggaggtgaagtccagaaccatctggggttgtcttcagatcagatgccagggtgcaggagagtctgtgtaccctacagcactgtaggtacaagcatcatggtgttggcagtggggaggtacagggggtaagtgtttagaggcctggaaccagaagatctgagctttgagaaaataatccccatcacaagatgtagcagagatactgatgtggatacactaggccagggagctctgtgaggagctgttgttaaaatgagggagggaggagaaccaactaattggtcacttcctatatgtgaaatgtagaggaaaacaatattaactagaatcctatctcattttagtcagttctcctttgtaagtagttggaaggtgggataatttattttcaaggttaagtaagcatctatacatctcctttaccttgtgaagtctggtggcgaagcgaaaaatggtacagccaatggagtcacagtttaataaataactcagagttcaaagggagactcttatgggccagaaattggtaaatgttcctgcattctaaaattaggaggatcttattttctttgaatcggcagagaaggaagcacaggcaatggggagggacagttgggaacacggcagagtggccacaggatgtcgaagacaaaggacatgtaatatcaaattctaagctgtgaagctgtgatgcaaccctccaccttctcctaatggattttttaggtctcagcacagatgcccacctgagggagtaatttctttggaaataaaggacaaatagctcggttaataacaagtccaccttacaaagcacacctggaaatggaaacaagattattcctaaggccttttctactctaagagtctctaacttggtggcaaggtgagaggtgaggatgggggtgttttgatccacacgtgatgagtaccatgaagctctaccatgaagcatatagtgttgagtgtgaatcagagccctaagaataactccctttacgttgttgtgccctctgccatcccaaacccaccccacccataattaagcagccacgaaaatgaggggagccagaaggaatcaaaccctgctgcttggttcagtagacagaaggacctggaggaagggtgttggctgggtctaggagaagatgatgagctcagaaaatagacaaggagaaaccccaggggaaaacttgtgaaaccccggaggaatcacaagatatgttatttgagctccttttaaattttatttaatactaaattaatggcaggaatcctgcacaaagggatattccctatgaaacatgacatctcagataaaaacagagcattcttccttaccctaaagtctgccctctctccccaagtccctcatgcatcaggtcacctttgtgcccataagtcatgggcagcgctgtgtggtcaacatcatccacacctagaggacagtcagcaaagtgaggtggttctgcctgctgtggtctcaccccaggcatggaaagcaagagccctgggagcagcggaaggtacacagctgggtttctcaggagtctcatctgtcagtgaattgacaagaaacagagcaaaacgactcctccaatgttgatgagcctgcccctgggatttggaaacttgataacagagaaaaccaatatagacaaaggattttaaacaggattatggtcaattaagcaaattagaaaaggatacttgaaggagtatttgggacacagaagtcaaaaacactaggaagacatgaggtgtgtccctaagactctagactacagcactgtgtagataactaacacttaactattaattatatcattgaagaaataaaatttacattgaattacaaactgtttccaaaaggtcatgaaaatcttgtagacttgtttcaaatcacacaaatgtgttcttctcattctcagctcttcactggtgcatttattttggatttgatcatctggggaagaggtgtggcctctcctgaaaggaggctctgggcccaggcagggagactgaggtctcagaatgactcccttgagagtcctgttcccctttcatcaatgcacagacccagaagacccctacgtcctgcagcccctgccatgagcatcgggctcctgtgctgtgtggccttttctctcctgtgggcaggtgggtcctggcagagccccttgcgtggatgtcaaggcccatcccctttccactggggctgcagcatcagctttgttcttctctgcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagttattccacagcgctgcaagcctgtctcctctctgcacataaaggcacagaggctctgccctcctcccacccaagactcaaggatgccctgggcagagttctctgcaccaggaaccttggaacccagagtggccccaagtggccaggacagtatgagtctcactctatgccaggtgccacttcaggcagtctcagccaggcctggaagtggtcctaggttctcagatgtctcctttgttgctctctctggtatatcctccaagctgtcctttttgtgtagggccagggcttccccagctcctactttcctactcattatcctgaatccaaggtgcccaggatgaaactggatttgtatgtcagattcatctatactcccatctctccctggtgaccctgttgcttcctctctctatggtttcccccagcccccatcctcacgtgatctctcctgtggcccacctttcccatctgggtagtcaccctccaagtccttgctgggtctctcctcccctcacctccccgcccctttctactgcagccattaggggagcccctgttctgtgcctccttacttcccatcacagagacttcaaagtccatttcctctgccctgggctggagccttccttcctctaatggccagctcctacctgtgcttcagatctcagcatgatccgcccctcctgcgggaagcacaccctcacctccctgctgagatcaactttcctctcataagctctcacagaatcatatgtctgttggtaacctttagcacagttggactttctcaggtacttatctgattatttttgtgctccacccaatttttttttttttttttagacagagtcttgctctgtcaccaagctggaatgcagtggcaccatctcggttcactgcaacctctgactctttggttcaagcaattctcctacctcagactcccgagcagctgggattacaggcacacaccaccacacccagctaattcttgtttgtatttttagtagagatggggtttcaccacgttggccaggctggtctcgatctcctgacctcatgatctgcctgcctcgggctcccaaagtgctgggattacaggcttgacccaccgcgcccggcctctccacccaatttttaagcccatgggagctaagagtgtgccggctgcatttaccaatattggtgcctggcatgtggggagacccatttcacagagaatggatgagtgaatgagaggctgagtgagtgatgagtgggtggacgaacaaatagtaggaacaagctacatctactgtaaactggcagagatctagcattaagtacaagaaagcccacccctttgactgctgggctcaggtcggtcttggaaattgatggggaatcactatcatggcatccacacctgtgtcaaggcttcctcttgtggctgcagcacctgacctcctccaggtctctgtgctctccttcaggatctttccccacaacaaatctagacagatcagagatccgcttcaagaattccatccttaaaggttgttccttgaaaccacttctggtaagaaaatctccattaggtttgcatcaataaaacagggccactacaagtttgagagtgtaacagatttatgatcagaattagactttatgcatatgtgggaggagctgaggaagacaaggtcttgaggagagaagtcagaaggtgagggagccagtcagtagtcagggctcctgaagctctgggcaggacgtgctggagtggcaggaacatgagaggatcagagcatatcaggccatgcagtgggatcttgagctgggagcacaggaaaatgccaaggaaatctgtttctgggaaagctgttccctctctatgggggccacccctgcagatgcactaccaaacactgtgggcagcctggctgctgttggccagcatttgggaagatgaactggacacagggtgcagaaggaacaggacttcctaggtctgttggatgcctctatatctgctggtcactgactctcactgtccaaccacgataacctgccaattgtcatagtgactgttttatatctgtcttctaaatgttacaaaatgtatccttgaccatctgtaacccagaatgataaaagaaatggcattctggtaaatacaggctcttgccattgtagagttgacctaacacaatccagcacaggatggattctcccagattaaggcattggacctaacacaatccagcacaggatggattctcccagattaaggcattggatcacacaactgccccaacccgccacaatccctggtcttctatccgggggacacctgtgctgcccaggtgaatgtggacacaatttgtgtgtagatgttccagacgctggtgactaacttttcttttaatcctgtgcctgaagtctccctccacccagagagtctatatgtgtatatctgtctgtctatctatctctatctctatctctctctctctgtaatttccacttggaagaaaatgtcatgatgactacatgttactgggatttatttatgaaaaggattttattaaaaagaattagaaaatttgaatccttttctgaatttttccttgggactgtcctgagagcatttttgacatgaccaacctttgtcgtgtgtgtatttggcagcctagagtgcagcagagagttattggccccacatatttgcgagttagactggagatggctgtaaaaatgactgactcttagtgttattcactctcagtctgggcctcactagaatgtcacagactaccatcgaacaaatagattcccagtatgaagaatattaggacatagcaacgaggaaacatgagcacaagcaacaaacgtttgaagtgcaaacctgaagactcgaaattttggcattataagatatgaaagtttggagagctacatttaaatgaacatgagggggaactgaaacaaggaaaaagagaatgtctgaaaccaacaacttgcataaaaattgtcaaatagtatatctaggaatgcctcatacaatcactgaaaacaaaatggaaaggcaagcagttgataagctcctcctatagagatttttagtgatgtcaaagatggatctgcaggagtgatctagaatgcagcacagaaaataaaaagtgaaatatgaaagaagttaaagaacaaggaagaaaaaaatggatgtttcctatgtattagaatatgcatatttttcataatttctcattcttttcttgcatatgatttatgtttcaaaaagataaataggaagaatgttatgaggtgatatttatgagatgttagctgagaatttttagacgtgtttcaggacctaagttcagagtttccagaatcaaaatgaatctcaaataagacagtcaagtcatagggaaattgtagaacatgagggaaaaagagaagattttgaaagcagtcagaaaggaaagagaaatacgtcccatagaatagatggagaacaacagtaagtcaagatagtagttaaaaataaccattagctcaattatcattctccttcatttaaggtgagattgattaaaaaaacttttagaagtggaatatgaaaaatgactgctgtgagtttgctaccaaggtctctttactgaattacagttaagaaaggtgggaaatgatcccagaagaaaggcatgagggcagttcgtgagggaacccatgtgatgggacagtcccattggacacgtgtgactgtgggaatggaggaggctggggcatcagtgaggatggcagaggggaccctgaattgcaggatagacaatgagctcatgccttggtgccttgtgttgggggtgctgttagtgcatcgacaggacatgcccagcagacagaggagtggctgtaggatgagaaggtgaactcagagatgtagtgtgaggcccacgggtccagacagcatgggagcccaaaaaatgaaccatgcattgatagtggtaaaaagctgatacatatttaaagcagcacccaagtgtgttctaatagaaatgctgtgaccctgaggtcctggggattgagagaggaagtgatgtcactgtgggaactgccctgtggagacaaggacggcccttatcctctgcttctgttcacagtgacactgatctggtaaagcccccatcctggcctgaccctgccatgggcaccaggctcctctgctgggtggtcctgggtttcctagggacaggtgagtcctcagaacaccaagtagtttcattttttctgtttgtaggtgtgtgtgtgtgagagagtggttgtgtgtgtgtgtgtgtatgatgactacaaatattttccttattctgttgccaaattctatttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagccacagcatggcacagttgcctccttcctgttcacaaacctcatccttctctctccttgcagctcctagagaccctaaacagaggcctctctttgctcctcacttttcatgggaaagaattacatctggacttcagctgttctttgggtagaaagagaccacagattcattcctgaaacacagtgactgaaaatgtaggtggtgaaaacaatcatgggagtccttggagccagctcactgctccaagcaaggagtgggtgtcttagtcttggccttcagggcagacatgcatcttctataggtcttggaggctgctgtgctgcccacatccatgaggttgtcatgggcaggaaacacgctcttctcctgcatatgttggggcatctggaaggtctgaggttacatcccaaggaacatctttcttctgaagcctcttctatccgtgtcacattagaggttttctgcaacaaaatatcgaacctctcttcctgtttgaagtaaaggtctttgcaacttttgaaatccttacttgataaatacagtcaggataacaataagacttcatttcttctgcctactttaagccaggtgtatccttcattttatttccatttgctattgctgctgtcctgatagacagaagtatgcattcaccaccactgccagttcaccttgattctctcaggaaatctgatttctagactctgagggttttcattgctgtccaactcatttgatttgaaataatttttctgaggccgttaagaagtgttatatttataatattgattctattgctgtttatttttcatattatatattgttatatagtacttgttatagatagaagtacaatgattatattgcaatagaatcttccacctgtctgtgggtgccgctgcagtttgtatctatgaaagcgaatgcactggtcagagctgatgtgattatgaatcatgggtttctgagagtcctcggcgacagaccacttctcccagtctgggactcagtgtcccagacacagccatgatagaggtgccctgagtctttcctaggtaggaggggcatcatagcccttcccaattcactgatcagaaattgtggttgtacagataccaagtttctttcctcagagaatgacggtctctggcaggcagttgctctggacccattttttattgtgccatcatgaaatccctccttgctcaggtgccctgtgtctcctgggactgagtaaggccagggcacagatgggaattccctgtcttcctagaccttctctctaatggctgccaccttcctccacttgactcctgagacatctggttctaacagtggataagctctgacactgaggctgaacagaacacagtccacaggtgtaaatggtgctgcaaggacatgtaataaagtgagcagggcttccaatttatactgagaatgaacatgcaacaggagcaaagggcagacattactaatgaacaaatagggtttctgctctaatgaaatcattctgttgtcttaagttaagcaggagaaacttttcattgcaattacttcaagtcaaaggctagcagctcccaaccaaccaggataactctttgctctgtgatctcagcagcttcagaggactcagaaatcctttctctgcacaaacttccctttgtccattccaaaacccaggatcacacactgatcctatcatgaaaacaatgaggtgtgctatagttgctgtggcctcatttttagggtgttcagtaggaagcattgaagaactttgaaagctttgctcttgagtctagggatgtgctggagccagcttgtatcattcagaagagccaaataggcatactcttcccagctccctatttagtgaagccatgttggcggcatgaaatctaccatggtgggtatgctggtacaaccgaaattagcaaatgctaccagccatgcccccaccttcacagacacccagtttatcagcacatccctggagtattttctgatgtccgttatgccatgtcttgtgggcccaaaagggctcagaattcacctcccctctagtcttgctcctagaagccatcatctaagggggcctccattgttcctatttctgttctacctccaaattctcttgccttgtggttgtctcctacaagcatgccactttggaacatgacaattattttgattgtgactaaaggtatcactgaaccagttaattttttatgaattatctttcctagcatggaatattcagatgctggagtcattgggaacagagatgagcatgcagcaacatgcaagttgtgaaacacttacagccccgctattcttctgtggcactgacagaccctgaaacaaggactattttgctttggagactaagcagctccgcaccagtcaggaatgactctgcttttactttaggctgagaggtcagaaggatcacaccctcagtattctcctctccaaggcggagtgtggccactctccatctcagtccctggaagttgcccagggctccctgagaatccctgctctggggcagaatcaccaaggctcatcctcgccagctccccacaggctccagcagggctttcctgccaggtgcagggcacaggaatggctctgcctgtctcttaggtagagggaggccatacaatgatgtttgtataagagggactgggattctgggtctcctttaaagtatttgacaggccaggcagggtggctcacgcctgtaatctcagcactttgggaggccgaggtgggtggatcatgaggtcaggagatcgagaccatcctggctaacatggtgaaaccccgtctctactaaaaatacaaaaaattagccgggcgaggtggtgggcgcctgtagtcccagctactcgagaggctgaggcagcagaatggcatgaaccccagggggcagagcctgcagtgagctgagatcgcgccactgcactccagcctgggcaacggcgagactccatcttaaaaaaaaaaaatttgacaaaattttctttgatttttgttctattttgccatctcaccaatgaggagagcaatctcttggtagttatattgtttttggctcttgggaaagtttttgtggttaagtcacattaagaaattgtgccttttttccctgttcagatataacccaaggcagtgaaagaaacagcaataattttgaaaacagttagttatgcatcctatgataaaggtgttaagtttcattgcccacatctaactttcagtctagtggaaatgaaaaggcacagttagggggcatgtgagcatgccatgagagaggtcaatgccaattgagaagtctgtgccaatccccagtactgtgggattgaatgggagggagagatgacctctccttcagactgttctgaacaaggagggagtgagagttcatccatgggaacctgaggaggagcaaatcccaggggcatctaactcagggtgcaggagcaaatccttggagaggaaaatggtccagttcagctgtcacaggagataggagaacgcaaagtcatgtaatccacagtcccctggctgatttgcttccttatgatcctattttgcatccgtgtttcctcaactcccgctgccccctgcctcttccagaatcatgttttggctctttggtgctcagatcagtggatgtgcattgtacaagttgatcatttcctgtacaagcccattgctgctcttaattatatccatccttattttgtgcattaggtactgctccctacaccactgcttattgccgtgtaataagtctcattttgtgtatttcagttttactttttattattacacatttgacttcatcttctgcttatctatacttttggggtaacattgttatttttggaggacatttttgtttatctttagtgattcagattaaataatctctttatacttcaacgtctgtcttttatttctatttaaaaccaaatattattttcttttattcctctcattctgttcctctttctttagttgatagttttaagggagaaaaatttagactataactggagctacgtgataagagttattcagaatgaggctgggatattaacattgttaactcaaagcaacagtcagcattagaactagtgttgggatgagggtttagggaagctgctcataaaacctgcagaatggtacttctggaatattctctcagctcactctgcagacacttcccagcattccttgggccattgcagaagcaacaatgatgaaacatcacttactggccataagatggcactgtggtccactgggatctaaagggctctggggagtctgggagagcagcctaggagggaaagggttaagaaaaattagggcttagatccagtattatgcagatgttgcagcagttttcagttttgccagactacctacagctatgcgagaggtgggaagtccctctaaactttaatgagatctacagttgaataattttggctggacagctttggtgtcagggacaggtgcagaggagcaactgcctcagagaaagctaggggcaggatgtgccctgagcccagtgcatctgcgctgcacctcatcttccctgcaggtcttgccaggcaacagctttaacctgctcaagtgatctgggattctataagtttgtaagtcgtactgataacatcatcttggctgagattccattgggcaccaagcacgtgtactctggaggacaaaaaatattgataacagttctaaaacactcaagtaaacaaactactgaaggaaaatgttaatagatgcaccaaactgtactgttagacttgaaaataatcaactaatagaattatcaaaaagagactacaaataaatctttactaagtatttgtgggcatcgagcagtgtctgagtcctctcagggtagattaaggaaggagttcagctattatcatgactttggcttggatgaaaatccatgacctcctcaactgattttcttgtaaaatgttacagaataatattgagcaaacattttatttttctccagcctgtatccctccttagcactaacaggtaaagcggacacctagaggcacggtttctttagttgggatccattaactgcaggactcggaggtccatagctgggcttcacagggagtgcaaaccccacgtgcaaggaaccccgtgtgtctgtgctgtgcccaactcccttctgtgaggctgccaaaggcggaggtccgggtgtcccaggaccccactcacaaagaggggagcaggctgcttgctgggcaaaaaaatcagttcaccaattggccaatatgttgaaaaccaaaaagaaaggaaaggctcaattgtgagactgacgaacacccaatttcccaagttatgaaatttgtagcagctcatggttctcagaatggtttcaacagcctatgaagatatttttagaaagtttttgtttgtctacagctttccttgatattgatcctcaggtttttttcagcccactcatcacttgaccttattttgtggccaaatttcagtgttgcctatttcagtcactgagcacttctcattctccaaatcttacacagatatgtgtgttcctgtcttttcttctttttgtgtgattcatttttaaattgggctgtgcagaatacaagcatacatttgtaaatgactcccatcttttatgcaatttagctgtttaatttttagtaatactttttatttaaggtgtaattaatacacagtaaaacacaaatattaatacaaggacatcctggtacattttgacaattgcatgcgccagtgcaatagtaactaaatgattattaaaaaactttccatcactcaagaaagtgtccttatgctcctttccaatcaatttctatcccagagataaaaacttttctatttttatcaccactgactagctttgtctattcttcagtttcatataaatggaaacatatttttattatttttcttcaaaattagtagttttgaagtgtattcatattgttgtatcagtaggtcattctttcttatgactaatattccattgcataaatataccacaacttgtttatccaagctcctgttgatggatatccacgttatgtctgtcttcaactattatgaataaagttgttgtgaacattcttgtggaattctttcttgcgaacatatgcattcttctttttttttttgatatagatttaagagtggaaatactcatagtgtagacacgtgtgctatgcttgcgtgtccccacaaaagctcatgttgaaatttgtcagtgtaatggtattgggaggtgggacagttatgactaggtcatgagggatctgccctcagaaagagatcaatgcccttattggaggggtgaattatgtcttgggaacggtcttctgataaaaaggatgaaatcagctgttttctctgtcttgggtgcttgcttccccttccttctgccttggataacagcaggaggccctcatcagttatggacccttgatcttggacttcccagtctccagatctgtaagccaaataaacctcttgtctttataaattgcccagtctgtgatatttctctatgtcagcaggaaagacattgaaagaaaaaatggtaccaagagtgaggctgttgctataatacctgcaaatgtagaagcagctttggttaatgggaagcggctaatggatagaggttgaaagaactgggaggagcagactagcaaaagcctagactcctgaaaacagagcattaagggcaattctggtgaaggctcagggggaaatgaggaacaaggtatcggaaattgaagtaaatgccatccttgtggtaagtagcaaaatccttggcaaaactgtgttctgttctaggaatttattgaatataaaaattatgagtcattcgctaggatatctgctgaaagaaatatctaagtggctaagcattcaggctaacgtgtgactactttcaggcaccaggaaatttaaccaagcaagaagggagccaagggaatagattttgcaaaccagcacagatggtgaccctacctccctctgctgtcccatctccaataagacaaattctgtgctgttagctgttaaagccctagaattatttctgaggaatctgtactcttcataatttacagacaacccagctctgctttggatctgatcagatggactaaatcttggggactctgcaccactggccactgaggaaagggaagagaatgttgcctgggacagaaaatatagtaagaaacattggtgtgaatctagcatcagaaagatgatgtgaggacagcaaggaagagcaggaacctgaagtttaatcaggctcctcgccctctgctgatgggcatgtgtgtgagctccagcatggagcaccgcagcactaggtcagaggagagtaagagggcgatggggcagcctgtgagctggggcagtgtaggcagaggagtaactgtatcatcacagaagcttctgccttcaaccatccctccagctctgcaggacaggtagagagtccagggtctgtggggcactagacctaaggaaggcttcctggggaggacacaggacagcgacatcacaggatacccctcccatcaggaaaatgaaggcccagaactcactcggctcttccccaggaagaccaagccctgaatcaggtgcagtgccgcctggcccactgtgccatgggacccaggctcctcttctgggcactgctttgtctcctcggaacaggtgagtcctgggcacaggacagcagccccattctcagctttcccaccccagtgtcctccactttaccttggggaggacctctgggctgtctcctgagctcatcctccatctgcttttcctgcaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcagcttggcacagcccagcagaatcactgacattctgtatataaacttcctgccttagctttgacttgagagctgcaggccccactcagtcttcactccttcaagggaagcttttagttgtttggaaggcatgtcttgtgtcctactgagggcacagctctcccaaccaacagagcccaggtttcctgtgccctgagtgtgcccacttctccgctgcatcttcttgcagcttgtcacttcctgggtaacttcagtagaagagtgactgctgagccccagatgtgtgctagattctttgtatttgttatgggcttaaagccttgcaacaatcttgtacatcaagcattcttattcttccttgacagatgggatgctcagggacattgagtcattttccccgttgtctcctggcttgtaaggatcagaagtaggaaacaaagtagtccatccattttccacctacccccctgctccatcatcaccttctgcatcctggtcagagtaagtcagaaccctcacactgccctctagtgaccagcagggccgcagcagaggctcagatgccttcaggggtcattactatggcctcctcattagcaactttgaggaatgttaaatttcacactttctaaaaatcatttatatgcattccctgtgtctttccccagtctgcagcttatattttcatttaatggtgttttttgatgcacaagagtttaatttaatgcaacaaaaactaaaaacaattttgtttgtgtgtagacaaaaaccgctttcccatataagtgtctaaatatatttttctcaatttattctaggaaaatttaagtttggattttcatcactaagaataaatgtatctgaaatatatctcatgtaaaaaataaggtggaaacctaggaatgggagcgaaggacatatgttcagtgaagatgaaatagtgtgtcaaaaagagctggaaagtagacacccggagctgatggtggagaggtaggtggagggcaaataatcatgaaccttgtcagtttgttatcttgtataagaaagacagccaggagtagagaccacatgggcaaaggtttatggctggtctgtaggttgaaggttgcagcaggtagagggaggaatagcaggcagagggcagagtcactgtagggcaggggcagtggcatcatcagttgactttactgacatccaggaattatgtccctaacacacaagctgaaaaacctcccacaatttgcctatttttccctgaccctgccatggccaccagactcctcagtggtgtggccttttgcctcctgggggcaggtgagtgccttaaagccttttccttggctcaccacatcccagcctaagcctttacctcaggtctacattattggggtccctccttgggcactcaacttccttctatcatagatttcacagaagctgggacaaccagatcccaagataccagagaacaaaggcaggacgtgaagtgacatggagatgcctgagactgccatccatgactacatgtgtaggtgttaataggagccaaggctggtgcacagctgatccgtcccagcacacactatacagaatccctgagggtctgtgactttttctcaaagccaaatatgtggccttggtgtcagacagcctctcccagacctctgtgcccccttgcaccagctttcaccccacagccaccttcctctgcacacaaagctcagtggaaaatatagatggccttgtcttcacgagaccgtgatccaggcagtggaaaacattgtcccataggagtctcccaacactgcccaggctggggccctcagatttctgagcagccctgtgcatgggaaactctgccctgtgctgagcttctcttccaggccagtctcagctggacgatggaacgcacataaccatgctttgcgtggatgcagcctctcttccaggcccctcctgcagctctgacctcagaagtcctcttcctcagctgctctcagaaaggaaagttcatttgaaattgtatatttgcagacagcattgacaatacaggtctatgttcttttccctgtcagccttcacaagtccatcttccccacaccacactcacgtcagtcctcagcctcttccacgtgatgtctgctcccagctgtcttctcccttcctctgcaccctcaccttcatgtcaatcacagatgcctcaattcaggcccttcctcatgggtcatgctcctcccaccaaagccctttccactccatgctgtatcctctggctcatcagaagtctcttctcttttgttctttctccaaatctcagtttaactaccaccatctctagggagacactccttcaacagttttcctaggctgctcctccctattgtaaatgctcacagtttataatatgcattaatattcatagacttagcaccatagtcatttccctgactttgtgtgactgtttgacacttctcttgcattctccactgtaaaaggcatcattctagaagttgtggatgttttgttccccattttattgtcagtaccaacagcggttccaggtgccactgaccaatcttgaaagaataaagaacagatattgaaaggccctctgagttcccacatagactgttccagaagtctggacacattaaatgggaacttctatcccttcatatcctaggatcaaatgagtcctggaaacagaggagaaatccctgtcatggatgagtaactggatccaagcctttctgcactactgaacttcctatctgcccatcgccttcctgcctagtctcctccttcaatctccttccctcacaggtgtcctggatttgggagtctcacagacacagcgcacctaatcactctgagagagtgatcagaaacataatgtcaaacactggcattaaaaggtcatggagaagaaaacaaatgccttccccattctcttaggcagagtgttcccaaggcacaaatatctctttgggtggctttgaggccatgctacctgacacactgagctatattatgggtgttcatttccatgaattggtgggcaatgctagagacacagacctgatggtcaccagcttcctccagcccacacctgattttggtgcagggcactgaacagagacctttgcttattcccctcctttgccagttaggaaaggctgattgtgaggcagaggctccacttacagagcagggctatgtgttagtccctgaagaattgtgagagccattctgggtggaaataatcaaatatacaatcaccaaggatggcccacggacagactgaagccccaattttgctggaatgatttgcatctatgctttaaatacgaatgaagttttatctctttaggcaataaagaccaaaaatagactagctattttaaataactgaaccttaaacaaaccaaagtcagaacatcttccctagggacagcattttcttctacccactcactaaagctgtatttgagaaagctgtgtgctgttgataaacactggaatatcattacaattgacatcgtaataatactgctacttggatcagaaacaaagagcatttctaaagcttgaacaatgtaaaactggaaacgagctctcactgagtttggaaatgcaggcactagagggtgctcatttctcttccttttccaatcggaggctattcaaaggctgttctagaacaaggggtgagatcctccacttctccgtggtgatcaggctttcagaggtagaagccttattggttcataatcagctgaactgacctcaccatcaaatgtatcgaccttgatgctcaccctcctcagcagtcagagactgtgttcaccaggagcttatacgcttttacatagtacactttatcctcggtttattccaaaaaatgggcatctataaggggttccataaacagaagctttctgtactttgcccatttagacactataaagtcagacaccagctgaaaggtgtaacttaaaagcttgtatgtggtgaagattttttaacaaataatatataatgaaaatgtcaataacgctctcaaatccaatcccaccttccactggtcaccaatattaacactctggtgtgcttcttttcacctctcttttctgtgttcatgcacacctttctacccaagtacacctacagaaaatgggttcacctgtacactttacctgtcacatgcatactcttttctgttaatataccctggtcttattgttccagattggtcaatatagatctaacttgctcctattagctgcttcatattgcataatgagggtagacaggtacaattgtgctctattgtctaattcctgaattctgccagatcttttctaaagagactgaatggcctctttaggcttccaggttgtcctcaccccagcccccagttgatgattccagcatttccatcactcatagtcctggcaggtttgagagctccattggtttctcctgcatgaggagacagggagggataaaaggatagacctttatcaatcctaccagacactacacagtatctcagttcgtcctcctaaagcattgaggggaatgttagtcttgttttatagatgagtctagatgcagctagagtccaggaaggttaatgaatggccttgcccatggtctcagagctaataaatgttggaggcagatgaagggcagtcagcttgcttccatgtggaattgatagaggggtcactggagtttgacagaggggaagtctagaaccatctggggttgttttcagatcagacaccacgggtagtatggtctgtgtaccctacagcactgtagatacaagcatcatggtgttggcaatggggaggtactagagaggtaagtggctactggcctggaaccagaagatcatagctttgaaaaaaattattcccagcacaagatgtagcagagacatcaatgtggataaactaggccagggagctctgtgaagagctgttgttaaaatgagggagggagaagcaactaagtggtcacttcctatacattaaatgtagaggaaaacaatgttaactagaatcccatctgattttagtcagtttttcgtttaagtagttggaaggtgggataatttattttcaagtttaagtaagcatctatacatctcctttaccttgtgaagactggtggcgaagggaagaatggcaaggccaatggagtcacagtttaataaataactcagagttcaaatggagactctcatgggccagaaattggtaaatgttcctgcattctaaaattaggggaatcttattttctttgaatcagcagagacggaagcacaggcagtggggagggacagttgggaatacagcagagtggccacagaatgtcgaagaaaaaggacatgtaatgccaaattctaagctgtgaagctgtgatgcaaccctcctccttctcctaatggtttttttaggtctcagatgcgcacctgagggagtaatttctttggaaatgaagaacaaatagctgtgttaaatcttaataacaagtccaccttacaaagcacaactggaaatggaaacaagattatttctaaggccttttctactctaagagtctttaacttggtggcaaggtgagaggtggggggtggggatggtgttgatccacatgcgatgagtaccgtgaggctctaccatgaagaatacatttctgagtgtgaatcagagccctaagaataatgccctttacgttgtttgggaccaaacccacctcacccataattaagcagccatggaaatgaggagagccagaaggaatcaaaccctgctgcttggttcagtcgacagaaggacctggtggaaggatgttggctgggtctaagagaagatgatgagctcagaaaacagacaaagagaaatcccaggcgaaagcttctgaaaccctggaggaatcacaagtcaaatttctcccagaagatggtggcagtgactcaccttcaggtacaactggctggtgctacagagctaagatggacttagtgtgttggcagtttgcaaaatctgggccatttggtcattttcttcagtgactttttaaagtgaagttttacttccaacattggcctgatgtgtgggtctgttcttatgggggttagggttagagttgctccattacttgagtacccatgaagtattattggtcatagaatgagcaggattatcaggagtagaaggggtagggagagggagaactgttaagtgaagcagtagggttgagtgaagagtattttagacatatgagtacatagagggatgaaagcccagctagcccccagcccccatagaaggaagatcaagatttgacaactaggagaggcatgattacaccatgcagcttgatcaaggactgagaaagctttctagacaaatgacaggtaatgacccacactgtgaatcggtattgaacgtgagatgtcaatatatattcatatatccacttatatatctaaaataagaagtccttacaaaccctgaaaacataaaccctcactattacaggatgtgcaggtgatttggatcctgtgaagaccctcaaacaggattaaaatccagtaggcagaggtctctgattctttgttagctacagaggaagatgtgctatgatggacacctagggggtctgggggtcttcccatccccttcccagatccacacctagaggaatgtcaggcagcacaattcagagaaccaccagaaaagctgtgagaataggactccaatctgaatccagcttctctcagctctgcaccccttgctgtgtaggagtcagtgcaggagaaagctgactgggtgagaagagaagggatcctgaaccatgccagaggagacctgtgaactgggaaatgagcagcaacagcaccaccacagacacacactcgccaggcacagggagaggacagatcctggcctcttgtagcaccagagctctgaacgccctctacctgctcagtctcccatgggatctaggctcttctcctgggcgctggacatgccttggtttctcaaaaccaggtgtgtcctggatgcacctgggggaatctcagctctgaatatgccaagccttgccagaggaaccatgtattttgaaaacccacggggtctgtgttaaaaacaacaatttccctctcagagcatgatgggattccatgttcctgcttagttgtgctttgtctcctgggagcagatggctctggaaacctctgagggaaatccctgtccctgcaactgctgtgcctcagttccaaacattccccatgcagtctcctacgtcctagctccaggttctatctccattcatgaaactgtgctcacacagacctcttgaaagcaggtaatgggtatggagcagcaataggtgtgaatacatcctactttatggcatcatctatgggaagcaatgtcagctggaaatgcaccagcatgaattttatactattgtgatgtagcacttctgagattgaaggtacaatggcatattccaagctggtcaaccaaacatctcactccatcagctggacacacatcccctagtggggtgggattctgtgggtctccttttgccagcagcaaagaccttgctgaaccatctcctctgctttgcttcaaacttttcctccactttgcaggatcttctcaaatctgggtctaacttgcctgcagtgagaggaattgtgactattgtccctcatatgaaagagggtgcccatgaagttttaagagttaagttaggaatgaaaatgagaaattaattgctcataatgcagactgttaggaaccccaaggattaattcaactccctattttttaattgtactactcccatcacaatgtcaagggtaaaacagttctgactttttctaaaggctatggaacatttattgatttcagaggtgacttagaaacacaggaggtgtcgtgataagtagtagagacaaaaaagaaaaagtattgagattaatgaattcatatggggaattgtttaactgttctttttttaacctttagaatgagttgaagatcccaacttagcttggtgcctgctggaggcaacgtttcttcccttgcccctctgagctgtgaattgaaactctttcgggaaaaagacgcggcaattctctccacttcccaaacacctcccactcctacccagaccgtggatgggcaggaaatgcaggaacagagccagaaacaggagatctccaaggaaggttgacagtcagcactgggatcgtctgtgtaaagtgctgctgaagcagccaggtggcatgtccagccgacaatgcgaaaggaaaaagtgagaagacttcccgaaggcggagggtggaatgcgggcagcagccccctggagggctgagtggggaaaacaaaatggacctcacagaagctgtgtgtgtggaaacccacttctgacttatcacttgtcatgaattctatgcttcatggtgttacaccgtttattgtttctgatgagtgacagtaattattttctttcttgctggtacataataaagtggtgcacatcagagttgctgccatcttagacttaactcatcagtatcaggtgatcctgaggctcagtgatgtcactgtgggaactgctctgtggcgacaaggacgtccctcatcctctgctcctgctcacagtgaccctgatctggtaaagctcccatcctgccctgaccctgccatgggcaccagcctcctctgctggatggccctgtgtctcctgggggcaggtgagtcctcagaacaccaagcaatctcattgtgtctgtgtatgtctgtgtgtgtgtgcgtgtgtgtgtgtgtgtgtgtgatgactacaattgttttcctcctgttcccaacttgtatctccacagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagccacagcatggcacagtcgcctccttcctgctcacaaaccctcaggcacttacttctccttccagctctcagaagccctgaacaaaggagctgccctgctctttcctcagcaaggagaatgaatgcatttggaactgcaggtgttcttctgatactaggaggtcagaaaataacctctgaaatacaggaacagggaatactgggtagtaataattttgacttatggatttctgggattccttatatatagttcaaatttccataattaggatataacagagcttagtctcatggatagtgactaagtaaatattcttttatagaactatgaagtttcagcacatttatattaaactactgttaccacatgtcaccaactcagacctataatctaccaaggagtggggaagccaaacgcaaacactgctaaggccatttacagctaccacccttggaagaaaattggaatctttagtaagaatttccatcaaaatcaattttttagaaataactattacccacaataatgcacattaactcatgttcatacattgctttttttccttctgaaaatcttgtagtcattctatgtttaatttccttcttctccagtctaacttaaaaaaatagaaatacaaattgagattgtttcataagataaaccccacctgggaaggtgttaaaaggacacaattcaaagaaaacctgaataaaattatatcaaccacgtaggattctttgaggtttccaaagaagatgtaccagtttacattcccacgagaggtatatgagttttggatggaatttttttttttctctctctctctctgtagattagtttttccctctactaatagtttctcttgacaaacagaagttcttaagtgacaatcattccatgtttctcccatttcagttagtgttttgtattttggtgtccactttaggaaatccttgcttacttcaaaatgatcatgttttcttacatttccttctaaaatctttatattttccacttttcatacttagactcacaatcgaactggaattaattctttgtaggtgatatgaggaagaggtcaagttctatttttccaaatgattattcaatttacccaatactatttaagtggtaatagtttcaccatcactcgataatatcacttttgtcataaatccgtcattatacatgtgtggccttttttctcggatctctattctgttacattggtctgttctgtcagttctcgcactgataatatgctgtcttactacagcttcatccttattcttaatatctggtagaataatttctcaagcttcgctcctttttatcaagtgttcttgagcactcttgacactttttttccatatacattttagaatcagcttgctaaattattcaggaaaaagataacaactgctgggattttttttgtttttgtttgtttccaactgatttaagtgcatcacagaacaaagctaaaaatattaatagaaatataaaaatatctaccacccaaaaatataaaatacaaaatatctggcatcaatcaaaaattacagacctgcaaagaagcatgaaaataggatctataaggaaaagaaggattaattaataggaaccaactcagaaatgacaaattggcagacaaagacagtcaaacagttactataactctggtctgtaagttcaaagttttgttgagatggggaaaggcataatgagatccaaacaaagcttctagagataaaaattacaatgtctgtgatgaaaaatacgctggatgaagttaccatcagattagacattacaggataaaatattaataaacttgaagaaataacacaaacaattcttaatgaaatacagagaataagtgggggtcatcagtaaactgggggacaactttaagtagcttaatatgtaattagagtcccaaaagcaaatttttaaacttgaatgaatttctttaaaggataattggctatttacactgaaataattccaaaacagtgcagggattctaatatatgcaaacataaatctataacaagactagcataaagacaggtgaggaataaatgaacacatatatcattggaaggtttccataatctgagtgaagtcacttgaaggcagactgcgttaaagtagagatgcaactgaaaatcatagagcaaccactaagatgacaaaacacagcattatagttaataagccaacacaatacagagttataaaaatgctcaaataatccataaaaacaacataaaaagaaaaaaggaatatagaagagatgggattgatagaaaacaaatagaagatgatagacccaaaagtaaccacatcaacaatcacatcaaatctaaatagtctaaaagcacagattgtactattgaatattatcgaatcatatcaaaaaaacaactatatgctgcttatcagaatactatgaagactcagaatgtaaaaaaatataaaagtatggaaaaagatgtactatgccaacaccaattaaaggaaagccagactagtaacgttaatatcaaacaaaataaatttcaagcagagaatatcatctgagataatgaaagtcatatcctaatgacaaaagtattggtctatcaagaggttgtaacaatcaaatatttacgtacctgaaaatggatcttcaaaatcccaaggcaaaaacagaactgcaaggagaaacagacaaatccacaattataatcagagatttcaatagccctcttttagtaactggtttaacaagttgacaaaaacaaaagacaactaaggatacagaagatatgaactacaccaacaaccaacttgacttaattgacgtttacagaacacttcatccaacagcagcagaatacatgttctcttggagtgcgcactgattgtgtgccagcatggactacgtacactgggccataaaacaagcatccatgcattaaaagtattcaagtcaaaccaagtgcactcgctggtcacagtgaaacttcattaaaaatcagtaagagaaagatttctggaaaagtcccgaatatttcaaaattagataatagttgtctaaataactcataaagcaaaaaataaatcaaaagataaaagataatttacaattattttaatagtatattttggtcattttttttttctttttgaccaaatactggtgagaatgaagataagtaagacctttcttttttattttttttttaagacggagtctcaatctgtcactgaggctggggtgcagtggcatggtgttggctcactgcaacctccgtctcctgggttcaagcaattctcctgcctcagcctcccaaatagctaggattacaggtgcccaccaccatgctcagctagtttttatatttttagcagtgacggggtttcatcatgttgggcagcctggtctcgaactcctgacctcaggtgatccacctgcctcggcctcccaaagtgctggggttacaggcataagccaccacgcctggcccaaatctttcttttttggggtgagagtaaattgtaaaaccgtttttgatgagtaatttagcagcatacatcaaaagagttaatactgctaacactccttgacccagagtgttttttatttaatgaatttatttcaaggaaattgctatatatgcataaaatgtttgagaatgttcaacagaaaagaaattattttaaactgaacaaatataaaaatatatcaaagttggtatgatgctgccaaagcaggactgaggggaaactgaagaacaggggataattttctattcattctgaggccagaactactctgataccaaaacgagactaagagattccaagaaagctgctgactaatatctctcaggaacacagattcaatgatccttttaccattacagcctagagaatctgacaatatgtaagagggatagtacaacatggtcaagtagggtttatctcagtaatgcattgttggtctgacattcaaaaaacagactatgtcatttaccttatctgtatgaaaaatatgaaaagtatatgatcatatctatagataacttaaacatttgataaaattccatatcctttcttgaagaaaactgttatcaaactcagagtaacaagaaattttcttcacctaaaaaaggacatttatgacatcctatggttaaatagaatatttttgcaagcaaactgataagtcaaagatgcatatgtaattcccagatcaaatactagaaacagcaaaaagaggataaaatagccttttcagcaaatggttctagaaaatgggataatatggaaaaataatgaatctctagccttatctcactccataaccagatgtgggcaaactatggcctccgggcaaatttggcctttgtctgttttcatacagcccagaaactaacaaaaattttacacttttaaatgattgaaaaaaagtaaaaagtattttgttacatataaaaatctaagatattcaaatttcagtaaacataaatgaagttctattggatcatggccacagtcattcgtgtatatattgtcaatggttgcttttgcactacaatgacagaattgagtagtcgagacaaatactgcatgatgcacaaaactaaaaaatttattatttcaccctttacaggaaaactgctgacccttcccataaacaaaatttagtaagagacacaaaaaaaatcccagataatcgaaaaactagaaactgaaagcttcctggaagaaaacatagcaagctctcttcatgatcatggggtaggcaaagatttcttaaggacaaaagaatgttctaaccataaaaaaagcaaattgttctttatgcaaatcccaaaaagttcttcaaaatacattacgaaaaaataaatgtatatctgagaaagggctggattcatattataaagaattcctacacatcaatcataaagaaggcaattcactaaaaacaaaaagttgactagagaattaaaaaaaaaagatatataagtaggcagtttcttttcatgagactaatgtgtttatttctccagacttagatgattgtttcactgatagcatgtcactgtcagctgcctccaggaattatctttggttaaagggaatgctttgcccaggtctcaccccattcctatggcagctggcatttaatgactggctgatatctcccttcctacaccattatttgatgaaatttaaaatttaaattaaaatgaaaaatttttctttcttgtttagaaagacatttgctttatgtctccctcaccaacctgtgcaaaatttgagtttgaggcaggtaaacctgaaatcagcaagagctgtgctgtgtcctgagagatcccgatggtctaatttaggaagcacccagtctccctagtcagggtccttagagcttcctcatagtgactacacactggccacttgggggcactgtggatccactgagtgggtcactgatagcgctgtctgagagagagagggttaagggagacagtcttgatttcgtctctgtatcagggatattaccagatgaaccagaggtactgctggcacaggaagagttaatcatagtcttatcagatcaactgatatgcaacgtgtatttgtcatgacaggaagccatgaactgaagccttgtgtggcctctctagcaacctaggtttgatggggagtgtgatgagggtttcagcagggcagcctggataacccaagccaggtggagataaaggagcatctgcctcagatgaaaatctcagaagctgtgcggatggctgtctgcccggaagcctgccccctctgctcagcacagctagcttcccctgctctgcaggaagctggacaggatgggggaaagcctgagttagctgagctagtcctggagtacagggtgcctatgggagcctacaggacgatgacatcagaacagtgacatcacagtaaaaacctccaaaaaacggtgaggaggagcaaaagccctgctttctcaccccaggagaccagcaacctgagcagggagatgcttagtcctgacctgcctgactctgcctggaacaccaggctcctctgccatgtcatgctttgtctcctgggagcaggtgagtcctgagtacaggtgggacatccctgtatccacagtgttcaattgttgctgaagtgtcaaactctcccgagctgagtcttcagcttctgtctccttcctccacagtttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagcttaggcacagaccctggagaattactggctttctgtacccaaaccctcctatctcacttgaggatgtaatagggagaaggaggtgggggctgccacacaactttagccaagccccagagatgcttctattcttttctaacattttcccctgccctgctgagctcagtgagagctcctgcacttgtgggctccagacccactggaagttctcacatcttagccagtactttttaattcctagcaagtggcgggagcttctactctgtgccaacataggggtatatgttttagtgtgtttcctgttgccatacagaatacctgagactgggtattttataaagaaatgaaatttgtttcttacagctctggaggctgggaagtccaaggtcaaggacccacatctagtgaggaccttcttgctggtgaggactctgcagagtcccaggtggcatagggcattacatatgagggggctcatgaaagatggtcaaactggcttttataacagacccaacctcataactaactaattccttctataacccattaatccatgaatggattaacctttatgagggcagagtccttaagatccagtcaccttccaaaggtcctacctctcaacgctgctgcattgggaaccaagttttcaatatataaattatttaggaacacagtcaaatcatagcagtacacattgcgggttttttttttttttcttttttgagacagggtctcactctgtcacccaggctgaagtgcagtggtgctgtgatcatggctcattgcaaccttgagcgcgtgggttcaagcaatcctcctgcctcagtggcctgagtagctatgactacagggacacatcactacaaggtgtgtccccagttcctcagttcctacaaggtgatgtgtccccttgcctggctaattttttttaatttttatttttgtagagatgaggccttgtcatgttgtccagattagtctcaaactcctcaaatgatcctcctgagtttatgtgttttaatgcaaagatagacattagcatatccactttatacatgtagaagatttcagtgtaccattttatagataggaagctgtggctcatgaacttctccagtatttcatatttccaaggatcaaaggcaggatccaaacctacgactccatgcctccaaaataaaatttctaaaattctatagtgtttcctgggccttggtcaatgagctacagcagagcactattcttccatctcaagactagccaagcagtagaagaaggtcacatattatggaatgtggttactatggcttatggcctgccaacctccaggacatataacttccagccagagaatatttgtcctgttttagttccatatagaatggggccacaatatgtcctaatatagacatatagtgacaaggggcatttctaatacatcacagggttcagtcaaggaaacagaatcctctaggaattccaaggagaataggagttaatacagggaattagtggttataaaccactggaaggctgaaaagtgggagggtctcagaaggttgaaacttgcgctcaggtccaccactagtgatcacaaagactgaagttgctacttttgcccaggtcagggactgctggaaatagctgagagtcatagtggtcttgcagtgaccaagagggtgattcacaggaaagtatccagaggtcattgcaaatccacctgtctgttgctgtcagataaaagtctttattctgcttctaacttttccacaagtatagcttactgggggaaacaaaactgttttcagaaacttgctctcaggagaatctaggaaatgtctttttcttttttttcttttttttttttttttttttgagatggagtctcgctcagtcgcccaggctggaatgcagtggcgcgatctcggctcactggaagctccacctcctgggttcatgccattctcctgcctcagcctcccgagtagctgggactacaggcacccgccactaagcccagctaattttttttgtatttttagtagagacggggtttcaccatgttagccaggatggtctcgatctcctgacctcatgatccacccatctcagcctcccaaagtgctgggattacaggcgtgagaccatgcctggactgggaaatgtactttcaagtcttctagctcttgcaataagagagagagagagattgttggaggacatttaagggtactcagtgccaaaagacaatcatcagcacacccagctatgcagcagagaaatggaaagcaggagaataaattttatattttctgtcaaattgttacatgaaaatttattttatatatatagctttgctgttgtcatttagttgttgtttacttgttaatttattcagtagatattcctggaatacctattatgttaaaaatttccttggaatacagaaaatgagatgtaatttttcaaattacacattctgtctttaagaagtctaaagtctggcaagataatatatccctaattattcacacatgcatttacaatgtatgaaagtcatttcaatcagtcagttttctggcaaggaacagatgacacagtcaaaaaggctgaagtgaaaacaatttaatcgaaggactatgtttagaggggtaaacagacttagggacaccaagaagtgtttgagggaccaggggtttccagcacattgggaagccagtacaactaactgtggggcctatggaaaaaggggtgggagggaaattctgtgttactggaggtgcatgcaagtaatgagaaaagtttcccaaaggaaggaattcaggaccagagctaggaaggggaagcccagatatgctgaactttctcttcactacccttcaatgtccagctggtgtcttccattggaaagcccagctgaaagcctggatagcaccgtttgctgacatcagtcttcaggggcacagtccagggcagtaaggggcaggcaggcgagagtcggttgtggggaactttgggtgtgcatgtagaacagccagcacagcagctaccaagtgtatgatgtgccatttgcagatgcatgtgcaagtacacggtggacagagaccaacttaattctacatcttttatgtgaacttagagaaaattgccttgttgattgctaataacaagcaacatcgttaatcccattttctctgggccatataccaagtacattatttcaattaatttcttaagaacttcaaaagggagaacaatttactcccatattacaggtaaaaaactgttagagaatttagattttctaaaggaggtacagctaacaaatatagaacttagactcacacctaggccatactgactttcaacctatgcttgaaggttactccaccctatacattttggtagaggaagataccttcaacattggaaatctaaatgtctcttttagaaacaatgcatctgacacaaaccatttgaataacatctttcatgtgggaggctgcacgctaaagaggaagatcctcagagatgaggagacctcagtagttcatcttctgatcccttgggtcagtgactttgaaaacatttggctaaactgaggccaatcatatatgtcttacagagattttatacatgtaaataaaacagagtctaatacatagtataggctcaataagtcttaggtccctatgaattttctgacaaatctctagtcaagcagttatttactttggcaatctggtaacaaaggcatacacgaattacttttgtctgattcacctatgattcagacacaaagtcatctaaaatgcaaatatagtagtctgataattcattggcaaaagtaacacaaacagttgtgtcttaagagaaagtgaaaatgttgtaccttacagcatttcctgcttgatactgagtctgatatgcaaggtgtgatgctcccagaaagttgtgaattcagagcaatcctgatggattccatctcctgttgctccagcacaaactcaatattgtacctttatcctggtttcctctctccctattttattctcccatctctcttattcctaattcctgagatcctttccaaaataaactactttcaccaaagtccatgtctcaaactttgccttcaggggcagcttaaaactttgacagtgatagaatgagatgaccctctaagacacttctctttgaaaaaggccgtggttttcttttagttacactgccatgcattcattcagaagtcctataatgatatatgaactatctcttccaagttcattttgactcagtctgagtttccaacagactcacatgggtctctgctcagttaaggctctgagcttatttgtaactgaatagactaagtttatgtttcacagcttcagggtctgcatggactcagagaaccattcatttctttcttcagtcattcaacaaaaatttaacaagagtatgtgcggagtagatccaagttttgcggaacatgaggcttataaaattttagggatcgctttgaaaaagagaatacaaaatgagaatgtcttgaaaaaattctgtgcaaggccaggcacagtggctcatgcctataatcccagcactttgggaggccgaggtggttggatcatttgaagtcaggagttcgaaatcagcctagccaacatggtgaaaccctgtctctactaaaaatacaaaaattagccaggcatggtggtgggcacctgtaatcccagctacttgggagactgaggcaggagaaccacttaagcccaggaagcggaggttgcagtgagcagagatcacgccattgtactccagcctgggtgacagagtgagactctatctcaaattaaaataaataaataaattctgtgcaagtgagaaggcctgaagttattcttcattgacttcatggcaaatccacttctagctagttaccgtgtgtaggcaccatgtaagtgcttgagaaacatcagcacagaaaacaggcaaaagctgcaaaataaggtgtatgttttcaacaaaagaaaattggtaaatcaataatgatcaagtaatacaaatgtaaatacaaggaaaatattcctggtagatgtttatctccccagagaagtcagagtattgttgagaattctattggtggatcacaccttatttattgatggatcacaccttattttgataacaattctcagagctcttggattccatgtgccctactctaaagaatctgagccctgagatggaaagctctcctttcctgtcctgactcaaccatgggcaatgatctctttttccgtgtgccttttggtctcccaggaccaggggagttctgggcatagatgggaaagctcttcctgggctttccaggccccagccacagcctctccatcggggtgttcatgggtcccctccctgtctccacttcagattctgtatccattctcactggagcatgagtgtaggaattacccacccaggttacatcaagatgtgcagtcacaaaaagggatcctcacactgagatgtgtcctgtatctgaaataacagtagtaccactattgactagatgtaaattttgcaccacagcacatttatggttcaatcaatatcctcccatttgtatttataagaccttctgaatggacacagggcatttccctatgaccttaaaggcaccaggctagtgtacttctgggcaaatatctcatatacatccctaatgagcttcctcttatttttacacaaaagaaaaaaaggagggtgggttttccccacatagtccatccactcacaagccaatctcctgcagaaataccctcacagatagaccaagaaatgctgttgtaccagctacctaggtatgccctagcctggtcaggttggcacctaaaattaaccatcacaaaactcatgagaacacagaggtctgagttctgatgatgagactcctattaggtgatggagactcaggtggcctcccctaaaacaaaaggagaagtcatatctgtattagtcatacatatgtgtatatgtacatacatgtatgtattctgttggttctgtttctctctgaggacgaggtggcctagatccttccctttctgggtaaagggtggaagcagtgtggatcattacttagtgtgttctgatagccatgtgtcactatgtacttgttctttgtgtcttcacatctcttcctgttgcattttaaagcattttcatagtatgtggtgttgcctagcagagcattctcatagcaaaaaaatgtatatatatatacatatgcatatatatattctattggttctgtttctctggagaaacggtatatatatatatatatatatatatatatatatactctccctgtatatatagtatatatatatatatatacactctctctctatatatagtatatatatatatactctctatatatatactctcctatatatagtatatatacactctcctatatatatagtatatatatatatacactctcctatatatatagtatatatatatacactctcctatatatatagtatatatatatacactctcctgtatatatagtatatatatatactctcctatatatatatatatatatatatatatatacacacactatatatatatatgggaagagagagagagaaaaagaaagaagagaagagaagagaagagaagagaagagaagagaagagaagagaagagaagggaagagaagagaaggaaagagattagggaaattggctcacgtgattatgaaggctgaaaagtcccccagtatgccagccatctgcaagctggagatgaagcaaagccagtagcatgactcagtccaagtttgaagccctcagaccacagaagccaatgttgtgtctctcagcctgagaccaaaagcctgacaacccaggggattgctagtgcaagtcccggaatccaaaggtaggagaatctagaattctgatatccaagggcagtagaagacacatgtctcatctctgagagagaatgcaaattcaccctttctgtgcctttttgtttcatccaggcccccagctgactggatattgccatacacattgagagtagatctttcccacacagttcatcaatttacaagccagtctcctccagaaataccctcacagacataccaagaagtgttgctgtaccagctatccaggtatgccttaatctagtcagattaacacctaaaattaaccatcaaactaccagcgggaacacacagaggtctgagctctgatgaggagtctcctgtgaggtgaactaatgtgacagggcataaaacaatatacaaattgtattgatcctgaccttaagactttttgaaaccttcccagatgtcaggtggctcttttaacagaggccagcactgtaggctgacatccagttatccagagtttgagaaaagataaaatctagtaaaaggtacttagaggcaaatttgaggagatgagttataaaggacaccagactgccacgagaatgtcccttagactacataaatattagaaacaattaaaacagcatataaatgaggaattgtatcctaatgggaataaaatatgcagagaggaatgcattttctttctaataacctgcaaagagcatatgcacttatgtctttaaaaatagtctacaaattattcccattctgagctgttaaattgtatatatgtcctataaaatattgttgtatataccataaattacatatatgtatatatttgatttatttttttggagaatgtaaggggtgtggcaggttaactttccagctcaactatttgtcaggggcactgatgtcatcgagtcactgagaacctaagttctatttccccaggcagggctgggagagatgagatcctggcctggacctgaaatgggcacaaggttgttcttctatgtggccctttgtctcctgtggacaggtgagggctggtcacaggtgggcttccttccctagaattcccaaggcctcaatacaagtctttttcttgggattacaacatcagggtctgttgttttctattacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtccacagtgctgcatggctgcctcctctctgcacgtaaacagcagttagaaagactgaggttgctctgtgtctatccccacccttggaagtccaggcctccatagaagtcagagggccctggccagcctggaagccatagagcaggggccttatgaccctcagtgctgacgtccattcctaccccagtctcagaccaactggaggtcaccccaacacacttagcttgccaagtctctcttctgcagctctcttttgctgcttgcagaaaggaaaaggcatcattagttgaggttagcgatgattctcttaaccccaaagcctggactcccttctctcccctttgggcttcagtgacttcttcatctgcccctttccccagctccactatccttccactcatagtcatgaaccttcactcctgacctctgttcctggctgcctttcttctatgggccaatagcctcatggggccctctatcatttgctcttcacctacatctccatcatcattttgcacaagtctcccctggctctctctgctccagccatgctcctttatgttcagttatttcctcatatgtgttatgctgtttcccaccctggggatgtgtgtttttacagattatttcttctacactgaacatatgttcctccctcttattcctaagtctctacttcatttcttacatgaaagtatatttcaggtacatttactcttaactataaacagaaaaacttaaatttcactaaaagaaattaaggaaaatatttttatcctttgagtgaagacttttttagtggaaacacaaaagaacacatgccataaaaaaataatactggatgggcatggtggctcacacctttaattccagcactttgggaggcctaggcgggtggatcacttgagcccaggagttcaagaccagcctgggcaacatggcaaaacctcgtctctactaaaaacacataaattagctgggggtagtggcgtttgcctgtaatctcagctactctggaagctgaggcacgagaatcacttgaacttgggaggcggagggtgcagtgagccgagatggcaccactgcacttcagcctgggtgacagagcaaaactccatctcaaaaaataaaacaacaacaacaaactgacattagttgtattaatcatgtatcgaaacacatgataaaaaatgaaaagtcaagccacagcctggaaaaggcataaggaatgcatgcaaatgaggaagaatcagcatgacaccatttatgttcacaaaagtcccttggctcccctacagttccaggcttcacatgcagttaaagtgctgggaacatatgaagaggttctgaataactggatgtgtgcagaactgatgtgggcaatcccaagtctggcccttagaaataacttgtggcagccacgcgcggtggctcatgcctgtaatcccagcactttgggaggctgagatgggcggatcacaaggtcaggagattgagactatcctggccaacatggtgaaatcccgtctctgctaaaaatacaaaaattagctggatgtggtggtgtgtgcctgtagtcccagctacttgggaggctgaggcaggagaatcacttgaacccaggaggcggagactgcagtgagccaagattgcgctactgcactccagcctggcaacagtgtgagattctgtctcaaaaaaaaaaaaaaaaaaaaagaaataacttgtggcactgtgaagggagtcctcaagtagacacagaaattagctgcaaagactcatgggatatagcatacagttgcacttatggttaagatttattacagtgtcatagtaaatattcagcagcggatcatatgaagaaaacacacaggaggaatctagaggagttcacacattggcttccttatgctctcttcctcccgggaggggtcacacagagctcacttcttccagcaacaaaaatgcattaacacgtgtgcaatgtttctgcctgtggagctcatcagagactcaacaccccagaggctttagtggaggccagtcatggaggcactcactgcctagtatgaacccaaaatccacagcccagaaggaaatctcggtattcagcacaatactgtttgcaatatcagtctaggccacaatgagctactcctctcggttaggagaaactatgtcagtgcagggcactgctcaccagccagcttcccagatgtcagccaaatgccaacctcacaagcaggactttctaagcaccacagtctcaagccttgctgttgactgttttctgtacagatcccttcaattcttttgccatgccctaataaacctgggagctacgcaatacagattgactaatgataatatggaagcagcctggctcactgggtcataatttggtgaaaaaccatgaaagaaagctacttatggcctgctgggctttgtggacatgggaagtaagacttcatagaattaagccaatgagattttaagatttatttttatttttttttctgtagcatagctgttcttatctaatagagttagtatctacaatgggtaaagcattctcataacttactaagacaatccaataaaatggcaatacttagtctaaataggcatttcacagaaaagtaaacataaattaacactaacataaaaataggttcttgggctaggtgcagtggttcattcctgtaatcccagcactttgggaggctgaggtgggcagatcacttgaggtcaggggttcgagacaagcctggccaacatggtgagaccccatagctataaaaaatacaaaaaattagccagtcatggtgggatgtgcctgtggtcccagcagctactcgggagactgaggcacaagaatcacttgaacctgggaggcagaggttgcggtgagccaagatcaccccctgcactccagactgggtgacagagcaggactccgtcttaaaaaaaaaaaaaagaataggttcttaacctcacttagaatcagagtattccaatctgaaacagtaaattatgaatgcaaacttatcagattttgaagactggaaagtcttcaaagaaatgatagtcccaaatatgagaaaagatgtggactagtggaactgtattatactacagaagaaaattataactgatatggttttgttctgtgtcgccaccctcatctcaaattgtaatccccatgtgtcaagggagggaactggtgggaggtgattggatcatgggggtggttttccctgtgccgttctcctaatagcgagtgaattctcacagggcctgatggtttatgagtggcagttttcccttctctttctctgtcctgctgccatgtgagacgtgccttgcttcccttctccttctgccatgattgtaagtttcctgaggccttctcagccatgtggaactgtaagtcaaataaacctctttcctttataaattaaattacccagtccctggtatttcttcatagcagtgtgaaaacagactaatacaataattatatcagaaaaccctttctgagatatattctgacaagcaacattttgaaacaaattagcaatatagttgaccctctatatcagctgatttggaacccaaggataccaaaggctgacggtaaggaaggtgggcacccttggattaggatatcagcagggtttcctggaaccaatcccctcaggatactaagagatgactgtgtgtttaaattacttgagttcctttcattgtctttagggtccatcatggagaattgagttgtcaatatttattttagccattttgaaggttttaattgatatttaaaaattaacacttaaaaactgtggttatacatatatgtataaccatggttttacatatatatatataatatatagtatatacattaccacagttttatatataaatataaaatacatattaccacagtttttaaatgttaatttttaaatgttttatatgtacataaaacatacaatttttcaccttaacaattttaaaatatacaattaagtggaatcacgtacattcacaaggttgtagaaccatcactgctgtttccaaatgtttttcatgatctcaaagagaaactacacccattaagcaataactccatctttcccatgcttctcagcttctggtagcctctaatctaccgtttgtttatatgaatttaccaactctagatagttaattgatgggaaattataaaatatatctccctttgtgtctgtcttctttcacttagcctaatgctttcaagattcatccatattgtagcatgtgtcagaattttactcctttatatagctgaataatacttcatcgtgtgtatagaccacattttgtttatctcatcatcagctgatggacttgtgggttgtttccaccttttgactattataaataatcttgcaataaacactggcctacaagtatctgtctgctttcctgctttcaattattctgggtgtatacctaggggtggaattgctgagtcacatgggtattctacatttgacattttgagcaactgcccaacagtgttttacagcagcctcagcattttatattcccataacagtgtaaaagccttccagtttcttcacagccttgccaacacttaatttctgttttgttcttctttttaaaaattattacagccatgctggtaaatgcgaagtgatacctcattgcggttttgatttacatgttcctaataattaatgatgttaagcatctttttttgaacttttactttaaatttgaaaattgtattatgtatacttcaggtacataacatgatatgatgagatacacacctataggaaaatggttactatagtgaaacaaattaatatagccatcatctcacatagttacccatttactccctgtggcaataacagatataatttactcatttagaaaaaattctgaatatatgaactatagttttcatgtggcacattagatctttagacttcttcatcctgcctatctgctatcttgtatcatttggcctaaatgttcccatttcctattccctccccctgccatcctcccattaaccactatttcattctctctgtatatttgagtttttacaaatttcacatataaataatatacactatttctctgtgtctggcttatttcacttagcctaatgtcctccaggttcatctatgtttgttgtggtaaatggcaagatctcattttttttttaggatcaaataatactccattgtatatgtatgccacagtttcttcatccatttgtccatcagtagacacttaggttgtttccatatcttggctattgtaaataatgctgcaatgaacatgggagtgcagatgtctccaaaaggtgggatttcattttctttgtgtatataccaagaaaagagattgctgggtcatataattctatttttaatttctttaggaacatctacactaattttcttaatgagtgcatcaatctacttttccaccaacagtgtataaaagttcctttttctctacactcttgcaacttatctttttaataatagctatcttaatgggtgtgaggtgctatctcatagcagttttgattttcacttttctaacatttagtgatattgaacatcttggccatttttatgccttcttggtagaaatgtctgtttaggtcctttgctcagtttaaatagggttatatgttctcttgccaaagagttgtatggggtctttatatatttggtatattaatctcttatctgacatatggtttgcaaatattttttccaaatccataggttgccttttcatgttgttgattgtttaatttgctgtgcagaagcttttcagtttgatttagtcccatttatttttgcttttgtagcctgaactttttgtatgatatcgaagaaatcattgccaaggccaacgtcaaagagcttttccaacatgttgcatgtaataaactgaacttagatagaagacctaaacattagatattaagcatcttttcatatattattgatcatttgtatatcttcttaggaggcaatggcttttcttttccagttgttttttagtttttctttgtctttagattttagtagttttatgattgtaaggctaaatgaggttggggttgaacttcacttgggagatttgtcgctgttagtgtttttagtgcatattctgaaacatttttaatagactgtacaacagagaataagtaaattcattgacattactgggaaacagagttcttacaaagggaagagagatacaataagaaatagggaaagacaaggaagaaatctgtggtgtttatttgaattggaggtatcaaatatgaactattatttaaaaattatgtatttcctaactctaaccatacaatatgtaagaagcaatatgaagtcgatggacaattgctttatttctttgtacttgtgttcccagtagtaatgggcagaattattgcatgttatttaatttctaaatgtttctaaaagaaacaaagcagaaatggcttcttctagatccagagcagggaaagtcaaaaacatcttttggcagaaatcaaggaagtttcatgacccagaaaacatagaaaaaagccacagaaccagtttcatggggctcccactagccaaacacgagtatctaaacattagagcataataatgaggacactaaattataacaaattttaaaaatctataaggctataatgacaataaaaagatgtaggtaagaatgtcttcattacagaataatgctagttactaaatttcattagaaaatcaatgtagccattaatgtagttacagacagagaccatcagttgatgtcaaaaccaacatctgaaaggttattggagaccaagatatctatattgtgtcaaagtatcactccactaattgcttattaactataaaatataaatgatatctttgcaatggagagatctgatgtctgtgatgttaaatttagtatcgccaaaaatgtgtaaagacagcattatatgttcttgtaattgatcggatgcaatgggaaacacacatcaactatggcatggtatttgccaaaatatttaacctctgataatgtggaaattctgattgggggtcattttaccagtcagctgacatggactcttacaaaaatcaagaccatgaaagttggaaaatataagtgggccaaagagatgtctagtttaaaagtagctaaaaagacctgacaaccaaaagaaatgcataatctttgataatgtcctgtagaaaaaaaattaaaaccaaaagacacattggtacaactggagaaaggggaatgtgaagcatatatgagaaaataatgttatatgaatattaagtttttgagtgtaataaaggcatttgtggttttctaagataatggcctctttttaggagagacatactgaatcgttaagaataaagtgttttatttcagaaattgagggtaaaatacacaaaaagagataaagcaaatgtcaaaagatgttaataattgaaatacattttaatattctctttgttgtatgattcagctcttccaaaagtgtcagttttttaaataaaattagaagaaaaaaatcttaagatcttgaaatgttggcatgatttcagttttgtggtggctatttattatattcattttcaatatctttgaaatattctataattaccataaaacaaacacacaagataaggtttcttttagccctatagtgtactttttctatagggacaggctatgatttttaaaagtccccccaaaagataagagaatttatagtctgaggacaaaatagctgatatctctgagatgagcacaaaacttagctaacaatgcatgtcaagaagctgtttagtaaatacacaggactgttttaactgaaacaggagattctgagttccctacaggttggtcaagaactcacagatgttggggaattgcctgaatgtaagcagaggagtggtagtgcttgtcctaaattgtggttggataatatgtgtttgtgtaacagggagggggctctagcaggactgaaacactgtctgtggggaggagtctctagcaggacagaaggatcacatggagctggaatgaattcccttcagtcccccacaaacactgtctgatagtagccctgatctaatttccattgtttagaagtcccaccactctccctgagccatggctggagggcctaagcccagtggctctgaaccattggccatcaggaggcactgaggtttgatggcgtccaaatgtttttgaaacagggctaagtattgcctgagaagttgagtttaaaggaaaagtgtggcttcatcctagcattcagtatctagtttgcaggtgttttgagtggtcaatggaaactcatctttctccactgatgccagtgggttctgttcggcagtgaaatctgaactgtagcaaaccattgagtggagaatcttctgagcccacttgaggggtagatggaggagagccaggagccaacctgaatgctcacagacccatgcagaggaacaagtgcctccttgggagaacatcagagaaaccttagcacctaacctattctagtgtgtcctggacgatggacaggagaatgtaaggggaatgtagaagatgggagtggacaactgtagatgtttccagatatctcaaattgcagtaacaccacaaatattcttaacaagaaccagattttccagaactctggcatttccttccctgagcaatgagacggccctttgggccctgacacaatcatgggtgttttttgttcatttgttttggtgctcaggaagcaggggaggcatgagaatacctggggaatgtctttcctagaaataggatgccccaatttcaagtatttcacatgcagcttgataggtcctgtctccagccacccagcctccactctctcaatgctgttgtcatccagggccctaagctctggtcacacggacggaagaggtagtgacactgtgatgtgaagacactttccaccatgaaattattaattggtgtcaatataaggcaggctccgactagcagcttttctaccacaatgatagacaatttatatggaaaagagatggttctgataattctacactcacaggtcttcacctgataaccttgacatgtgtcccctaggttttaggaacttggatttctttaggctgagttgtactattccctttctctgaacacacatgtcattggttagttcattcatattgattctcagggcttctccaatccctcaagccttcccactctaccactcagataaggagaagtgtgtcttaactaatgttgcataattttttaaaaattgctggatactaacactgcaattcaattgtaaaatatgatagaggtgtaagtgttttagatcccagaagtcctgctcaattttgcatttattgttggatattcaccctgatattttcaggaattagagtgttcttcacccatttgggttaagatatcagaacttactttcaattcattggtgaccagagactacaggcagaatcatagtgaaggcttgatacataatacataatgaagattgataacagcaaaaagggaactagtcattggccttcagataaaatgaaacctcccaactttgtgctcagggaattattttacccctttaggttagagtatgtcagctagttcaatgcagttctaggataaagctgtgtcaattaccctagaggactgggagcatggaggacctggtagaaaagaaatacccaaagagaaggaaaattacacacaaaatcaagaggtcactaattgatatatctattttgagttgcctttgagacttccacgtagaaacatctagcacaggataggcctagagatgtagtgacagatctaatcccccaagccctgaatatgtgagtgaggacgcttggatgaacttccagtctatgaatacattaaacaaacttttagctctgttttagtttacaacaactgttttctaagaacttaagcatttgtggagacaatgatgtcactgtaggaacttctctgtaaggacagcaacatcccacttcctctgctcctgctcacagtgaccctgatctggcaaagcttccatcctgccctgaccctgccatgggtaccaggctcctctgctgggtggccttctgtctcctggtggaaggtgagtcctaggaacaccatgatcctcacataatctcccagtgattattctagtcatttccttctattttaaaattctttttcccccacagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcttagacacagtgtagcagagacacttccctcctgtgcagaaaaccgcaggactctctcctctctactcagctcacagcagcctttccttattcctcatcctcccaggaaagaagtgagttttcagatatagctaggattcatatagtgggaggaaatgaactatttcttacaacatgagcgctataattgttgcttgaaaatgtgtctcagggatttgaaacacttcttggggacaactcaagaaacctaaagtgacttatcagagattgagtcctcaggggtagtgatggtttatctcccataaaagtatgtgatcatgaaacatgtacaataaacttaataatacagatagtgattataccaagcagcaaacagcaggctccccttatgtagttgtcagcatgtgaatgacttgttacccttagtgacaccccggctgtctagcaaagtctcaacacacagtatgtgtttggaaatctttttccttctgttttatttttggtaaagtatgctaataatgatgttgttaatgatagtgattataatttcaggtatgttattcagccctttttccagttcaaagaaatgcacacaaatggataccccggcaaccaggtgcaaatcttagctccagatgaattctacttctcctgaactctctaactcttctatgtaatcatcccagcccaagaatatatctagacctggaccagtcagttcagaggacatttctacgtgtctgccttgtatattaaaagttccttagtggattgaaatattccttgtaagaacttctgaagcaatcaattgccctctctgataatatacactctgtgtgtctagctccatattcattactctacttctgcctaaactctctaatactagaaatctttctgaagtattggttagaattacttaaaaagcagcatactggaaattgtctgaaagcactgtcactgtccatttgcccctcctgacttccctcccctccttatccaatctaatacctgatggcaagtcaggctttatttccatttgttcattgcacatctccctgtcctttattcctgtaataaaacctcactgatgtgatggattaaaatgaccactcactcaccatctccttgtcaaaatttctatttttttcttttcccaatctgctatgttagttatagttaataactccctcataacattttctgagatcactttttattatttgaatataggacacacagttgtttcagagtctgtctgatcattttcacctctaagatcttcataggatatttttgtgattttctttttgtgctgcttctcagttatggtgcttgagttttcatggcatttgtatttctccttaccaatctgatgatgtttgacactttgccaaacactatagttgtagaaataattttgggggtaggatggatatttttctgcagagatcatttttctgtgcttctgaaagtgcatgtagatataaacagtcaggctccctgaatcacagtttaaggcttgaggtgtcctggagcatctggagaacaggtttgtctctggcttattgttactagtggaatttggcaatgacacgttcggtatgttctgggctttgctttacccccgtggcctgtgagtcagcttcctgagtgctgagtcaggatctgcaaatgcccgctagggcaaatggactgctgtgctcacctcccggagctcttgccctcaccaacattccagcccaattattattatttttttaggactttaactaaaatttttaatgttgtttttgatattttttttccaactatgtagataacaacagaaagagtgagtgccattatccttaattattgggattaaggtgaaaataactttacctggaattctaattttccttgtattttaatgttagattctttgtgatttgtctaatattcaacttaaatggtatagagatgttaaactctgatatcaaatactttaaaaaaacttatcaagaccattcataatccaattgagacatatctttgtttggggcatgttgtttttagagtattcttctactgttatttatttctatcacataacctctgtgttccattggaccatatggcaagatgggaaagacaatcaagagaatgctgagatctggtcaaatagtacagattgggcttcaaattaatttaattactgagttctgggggtggatttgtgctgttttatgagtatttcctggggcaatggtcaaaattagagggagtaactgatatgtggctattgttttaccccgtttaaagccaatctcctgggacaacacaccccattttgtggggcaccccgaaagtaataatcctgttttaatcttcctattccttgccaaatcttctctacagaagggaaatcagttatactatttcctctcttcattttagtttagtctctccttattttcccgttttcctcctggttccctagagaaaagtagattattttcaacatgtgctaagatcagtgaggaactctctcttccatgcagggtggcctgcagtttggaggggatagggaatgggttaaattctgtttcagcatcatgttagccagcccatcgagtttcacaatgagacctgctgcttatcagtattaaaactgacattatgtttccacctttctgactgcattgtcaatgtctggggtgtttctgtcctaccccatagcactaatattatttgttggccttttaacaccaactaatcataatatcctatatcccttgtactcagtgaaataaagctcaagtccctgtgtcctggcaaaagagagcacatttgtgctgttctgcctactggccactaggaggcactgtggcttcgatgtcatccagagtctatggggaggagctgagattgctccctggaagatggttaagaataaccccgaggttggacctaaattcagggagttggtttgcagatgtcttgaatgatggctgggaataaaggaattagtaaccgacgcttcctccattgtagaggtgggttttgctttaaattgtgctttgagtggggctgagtgacaggtgtactttgcagtgcatatacctctgagctcgcttaagatgtaggggcacaaggagctgaggtggtgcagggcccatgttctgagcttggaaaaccagagaagcagttcttgtgtcaaaggagccttggagagcctggccccaaaccagcccaggccaaccctacctgctctgtgagagtagaacagcaagaaagggaggtgctacccaggaccacagcagagggaccctgtcgccagggagatgaaaatcacagtgatgccacgaccatatccacgtatgaggcatagtccagtgtgtctcctggaagaagatgaagcctgggcagacataagaatatgtttttgaataggcttcccttggcctgattttaaattccttccatgtgatcatgcatctgtctgtacctgtattttgtacccggcttctgcctctcacccatcagtcccatggctactagaaggtattaaatttctattgacaaaaattaccactaatttggtggcttacaacaataaaaatttattatcttacagttctggaggttagaagtccaaaaccaggctaaaatccaggtattggcagggctacattccttcccgaggctctcagggagaactatttttctctcctattcagcttctagaggccaccagtgttccttggctcatggccccattcaatcttcaaagccaacaaggactgggtgagcctttgctcactctgcatcactctgacactcactcttcatcctccctcttccacattttaggacccttgtgattacattgggcccatctggaaaatccaggacacgctccccatattaaggccagctgattagcaaccttcattccatttggaacattcgtttctccccttgccacataatttaacacattcccagtttctgggaattagacatgtacatctttgagaggtcgtcacgctgcctgccacacttgctacctggttacacgaagtagtaagcaattaactttttgaaggcagaattatggccatagttttatatcctggatccaacagaccctgcaaaaggatagagcccacatggaaatagcccctccagtaacacaagctagtctgcaaactaatgcccttttactttgggaagtgcttttgactgcaggggactcagaagcatgcctctgtgccaacagcaaaaatgtgcccttctcttttgttggcaagtaacttaaccaaccaacccaaaaaaaagatctttctctcagctttccataatctctgagacgaagtaggtttggagaagtggggttacaggggaaaaagccaggtgttaatgatgaaaaaacattgaacttttctaggggtagtaataagatttaattcaagactagaacattttagctgcaaatcttcaagaataagacaatattatcccctttctgttttattgtgggactagagaatgtgagagaggttacattccatgggctttgggaatttaatatggttcaaggataaacacacccaggtttttcactgcagagaagagcttcaaatataatcagttttcaggtcatcagctcagctcttgtatccctaacaatgcagttgacatgcgtcttctcagatgtctaactcctaactcactgagggatactttaagtacatataaaggactagaagcaccaagctaccagtgagaggaagaggagagtttgcagagaagctggcttgaaataagacaatgagttcatctttaaatacttgccatttgaggtgcagatggatatagttggcaggctcctatgtaaggcatgttatggagaagctaccgtgaattgataatatcaaaacaaatatccagggagcctctgcaagtgtgcatctctatttcacaccaattatagttgagttaattcctgcctgattcatctcccagagatgcagcctcctcttaaagaagttgggggtggtggcccattcagtgatgtcactgacagatgcattctgtggggataaaatgtcacaaaattcatttctttgctcatgctcacagagggcctggtctagaatattccacatctgctctcactctgccatggactcctggaccttctgctgtgtgtccctttgcatcctggtagcgagtgagtcttcagaatatttgccatcatcaggctgggcttctgcatggatgatctcatatattttccttattctgacgcccaattctgtcttctttcatagagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaacccggtgtttccccttctccttctacctcccagcagtcctgggcaaagtctctgctgttcctccctccctatgagaaaaaagtggtttgggggtatgaaaaagacagaaaatgagaagggatcaacataggaaaccttatgttggtttgaggattacaaaatgggttttgaggattccttaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttctttactatgattgtggacgttcctttataatgccaatttcaactttacattacttcaggatttttcactactcctaaagagtgtctcaaatgtggctagagcaagcaggttagtacactagatgtaagctacctggcctggaatctaaggatccatttgtctctgttctgcgtaagatgagccgggtgctggccaaaggctgtgcacactcacagagcactgatgacgcctcctggtaaggacccacactggggtatctaaaagcagacaggcatgtccagtcttctgttgccctgtttcctttctgattatatgtccttaacacacaaatttacattttccttcttatttatatgagaagtttctatacaatacctgcaatccattctgagtggttataatttctgtgtgatattcatatttacatgctgattccttctaaatacctatcatggtatcattgacaactgaggcaaaagacccctatattttgagtgcccaaggccattgaggttttttggagctctgccataagcccaattccactgtgtcattttcctatttttctttccttttttgttttttgattagtgggtcctgactttcaagatgaaaatagtgcagaattcctccctgctgcttccagatcattttccttcctacttctctaaagcccagctgcattataggcttcctttagcctgattttaaattccttccatgtgatcatgcatctgtctctacctgtatcttgtatctggcttctgcctcttacccatcaatcccatggctactagaaggtattcaatctctgttgacacaaattactactaacttggtggtttacaacaaaaactaattatcttacagttctgcaggtcagaagtccaaaaccgggataaaatccaggtgttggcagggctgcattccatcctgaggctctcggggagaactgtttttctctccttttcaacttctagaggccaccagtgttccttggctcatggccccattcgatcttcaaagtcaacaaggactggctgagctttgctcactctgcatcactctgacactcactcttcgtcccccctcttccacattttaggacacttgtgattacattgggcccacctggaaaatccaggatacactccctatattaaggccagctgactagcaaccttcattccatttggaacattcctttctccccttgccacataatttaacacattccagtttctggaattagacatggacatctttgggaggttgtcatgctgcctgccacacttggtacctggttacaggagtggtaagtaattaaattttttaaaacagaattatgaccacagttttgtatcctgggtccaacagacctgcaaaaggatagagcccaaaggaaataggccctccagaaacacaagctagtctgcaaactaatgccctttaacattggcaagtgctttcaactgcatgggactcagaagcatgcctctgtgccaagagcaaaaatatgcccttttatggcaagtaagttaattgatcaactcaaaaaacaaacatttctctcagctttccagaacctctgagaggaagtaggtttggagaagtgggattaaggggttggcagggggcggagaaaggtcaacaggggaaaaagccaggtgttaatgatgaaaaaacattgaacttttcttttctaggggtagtaataagatataattcaagactagaacattgtagctgcaaatcttcaaaataagacaatcttatcctctgttttattgagggaatagagaatggagagaagttccattccacgggctttgggaattcaatatggttcaaggataaataaacccaggtttttttactgcagagaagagcttcaaatataatcagttctcagggcatcagctcagttcctctatccctaacaatgcagttgacatgcatcttctcagatgcctaactcctaactcgctgatggataatttaggtacacatagaggactagaaacaccaagccaccagtgagaggaagaggagagtttgcagagaagctggcttgcaataagacaatgagttcatctttaattacctggaatttgaggagatgtatatagttggcaagctcctaggtaaggcatgttatggagaagctaccgtgaattgataatatcaaaataactattcagggagcctttgcatgtgtgcatctctctttcacaccaattatagttgagttaattcctgtctgattcatctcccagagatgcagcctcctcttaaagaagttgggggtggtggcccattcagtgatgtcactgacagatgcattctgtggggataaaatgtcacaaaattcatttctttgctcatgttcacagagggcctggtctggaatattccacatctgctctcactctgccatggactcctggaccctctgctgtgtgtccctttgcatcctggtagcaagtgagtcttcagaacatttaccatcatcaggctgggcttctgcatggatgatctcatatattttccttattctgacgcccaattctgtcttccttcatagagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaccctggtgtttctccttctccttctacctcccagcagtcctgggcaaagtctttcctgttcctccctccccatgagaaaaagtggttttgggttgtgacaaagacagaaaatgaggtttcaacataggaaaccttatgttgatttgaggattatgaaatgggttttgaggattccttaaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttctttactatgattgtggacattcctttataatgccaatttcaactttacattacttcaggatttttcactactcctaaagagtgtctcaaatgtggctagagcaagcaggttagtacactagatgtaagctacctggcctggaatctaaggatccatttgtctctgttctgcgtaagatgagccgggtgctggccaaaggctgtagcacactcacagagcactgatgacgcctcctggtaaggacccacactggggtatctaaaagcagacaggcatgtccagtcttctgttgccctgtttcctttctgattacatgtccttaacacacaaatttacatttttcttcttatttatatgagaagtttctatacaatacctgcaatccattctgagtggttataatttctgtgtgatattcatatttacatactgattccttctaaatacctatcatggtatcattgacaagtgaggcgaatgatccctgtattttgagtgcccaaggcacttgaggttttttggagttctgccatatgccaaattccactttgtcattttcccattttttttttttttttacgtgtagggatcctgacttttaagatgaaaatagtgcagaattcctccctgtgcttccagatcattttctccctcctactttaaagcccagctgctttgtacatattactttataatattaccccttctcattgtacctaccttattaccttcagaaattttcttttttttaatccttctgcctgctactaatccagtcatcattcttaatactattcatcacatagacaatttattcactcgcgaggcttctaagtttctcgacttcctatatcctgagtctttttcccctctaatcattttcagacttgtttccatgattatagaccattaaggaacaacaaagatctttcaatatttctatttaaattgtcctgtcgttctaccactacctcccttctgtctatatcagtaactcctacaattcttctatttctctgacctctccagttcatagagcccataacttttatttttttaatttttttttggtctttctaggatgttatttattaaaaatagattctctgtccctaccctcacccctgctggcaaaatggcctttcccaacatcttttcctgcatggataacaggtcttgaggacgcagatgtgcatcctacctaaactacaggctcaggcttttctgggacagtgaggcagcagctctgccagagccaagggtggaacagcacaagacgacatcagcaaaccctggtgcacctaactgtgggctgctatggagtctgggatggactggagttcctcctgctccaggcctcgggagacaaaatccacaaagagagacccagtggcccagcagcagccccctgagagcccacaactttttaactcttacgctttaattcttacattcttttaattatattttaagatttaagactataatatcaaccccgattaaagccaactccccgtaggttcctatgaatggcagagttgggaggggcactaaaaaatccccgtgggaactcattcgatttatcttctgtagttgtcatagactcctcttaggttcctctacttctaatcttggcctccctcattctagccaccaacccagggtctactctcaatacagaagtcagagtgatcctttaggttagatgttgtcactcgtccactaaaccatacagtagattcccgtttcactcagagaaaagcctacagcctgcataggcctacgaggtcctcggtgatccccctccctgttgtatttcttgcctcctgtctgttcctctttcccttgcttattttttcacaacacagtggctttctggccattcctcgaatacacaaggcacacttctgccttagaacctttgctcaagctattccctttgcttggaacatccttctcccaagtatcccagtcaggcctgcaagaagcctgaattattctaccagtgacacaatcattttcctaaaaccacttttcaatttttatacattcaacaattctccattgttcaccagataaaaatgtcacctcgggagggcatttgaattttaaaacatttggaccatatcttatcttatttttgactactgagtaagataaatgttactttatcaagtgcacttcatacccttacaaaacagtcttacacaatttaatgcctgttcatacatttgttcttgcaatttctgctaccttcttcatattgttcaatacttctagtcactcaagacactactgaatgcttctttctctatgaagcaggaaatggttctatatactctattttcacagtggagtaaaatagatacacattttaggaacaaaacaaccatgcagattatagaaattaaactattttttacatactttcgaaggtgaggaagttcagaagctcaaatatggttaagatatgttttgcttctatttaagtccacattccccaccactttaaatcttccaagaaagatttccctcattcaaattaaaaacattttgatacaagactgggggcagggaagtgctgggtagagaagggcggggtccctggtgagggctccaccctcgggcctgtgcccacagacctaaatgaggacaggcgtttctgtttttgcactcaaaaagttgccttttggcccgccacgcctcccatcctgtgcccatataaacccgagaccttaagcggacacggacacaagaggctggacatctagaagagcagaagaatacagcagcagacaccggcagatcagcgatggcggaaggacacgaatgcgaggggagttcagccaggggaagtctgcgagagtcctgccactgggcagccaactgcaggggaaaaccaccgttccactccatccctcgacttctggctccccatctatctcactgagagccacttacaccacttaataaaagcttgcactcaacctttcagcccacatatgatctgattcttccagtacactggtcaagagctcaggctgtcacattggccccctgtccttgcaataagcagagggtctattgagttgactaatgcaacgagacggcagacggcatagctgaaagagtgcactgtaagtcctagacgctgccatcccttggagcccaaaagcactccccatggcctctgcacctgcccgtctgcatgctcccctaggggtttgagcactggggcaccagtgaagtgagccatccccctgtcacatgtcctgcgaggagaataagggaattctccggttttaacttaatctgtaaaagaccttgttaagaggatgaaaaagaagccacagcaatggataaaacatttgtaaactacatatccaacaaaggaatattatgactgtttcgagatttgcagaactgtctatttaacccatagactcatgagcaataataaattattattgctttaaccagtgagatttgagtgaggcttgttatacagcattactgtgcaggtgtcaattgatatactctatattgcaatatcgattcttaaattgtctaaccataatcctatagaccattactaattccaagcttgttctttttatgaagagtgtcgctcaactctgatgtctttgttctgtttaatattttgatttacacatgaacacagttcccagcagctttcaaacctccagaagcccttaacatttctgattctgaaaaatatcttttcttgttttcagcattttttattgttattttttattcttttgtatgggaaggtactcagtttaccatcctgaattagtaattctttaaacatttttgcaattccagtaattagagatattactgcattaggcattgaagataccatggtctttgcatttcctgcttgcatatcgagtcctatgaactatttctggtgtctctgagtcacttcccagtgtggtcattggcttttactgagtctgattcaccgacctttactgagcctcactcaccaacctttggtcattcttggacatagaagcacaaattcaacagtgttgtttcccaaaatatgtaatatgcagggaaaattacttttcatgtaaaatagacgtgtccttttagtattaccagtagattattctaattatagactagtaacatccaacagacttatttgggtttagtgacagacctattactgtgttcgctcctcagttcaaatacagagtgtgtattttgcatcgtgtggctgcaagttttggggttctccatcatatacttagctatacaatgccagctactcttgtctggatattttcccaaatcctggatgattacaaacttctccttcactggtgaaattttttttttttttttttttttgagatggagttttgctcttgttgtccaggctggagtgcaatggcacaatcttggctcactgcaacctctgcctcccaagttcaagtgattctcctgcctcagccttctgagtagctgggattacaggaatgtgccaccatgcccggctaatttttttttttttttttagtagagacagggtttctccatgtttgtcaggctggtctccaactcccgacctcaggtgatccacctgctttggcatcccaaagtgctgggattacaggcatgagccacagtgcctggccaatttttttttttttaatgaagggtcaaacctgatattaagtctttcagacagtaagaagataactattcagggtctacaagatggccaattagaagcagctgtggtccatggcactcagggagaggaatgaaacggggtgagtgaatttagcactgtcaattgagatattcaggttctcacactgggactgtctaggcaaacaactcaacccacagagaacaaagaaaagcagggggtgtggggcatgatggcccaccaggagcagcacagagccaaaggaacccccacccccagccaaaggaagcagtgagtgattgtgtgaccctgcccaggaaacgactcttctcccacagatctttgcaacacatggatcaggagatcccctcacaagcccacaacaacagggccttggatccagtacacagagctgcatggagtcttagcagagcagctgctcaggcacacacagagacccaggagttttacacattccagcctcaggatccccagcaaggcaggaaatctgtccacatataaccctaggaagggagctgaatccagggagccaagcagcatcattctgcaggccccacttccatagcacctcacaagttaagacgcactggcttggaattccagatagccaatagcaacagcctagaatctgcctgagataagtatgaattcctggggaaagggggtggccaccatctctgcagtccagtagacttagctgtttaagcctgccagctttggagaatacaaatggtctggatgaggaaaggttccccataatcagcacagctgccttgccagatcatggccagactgcttctttaagcaggaccttgatccatcccttctcagtgggcaggacctccctgtggaggcttcagccattctagccagtgttctacattgagagctctgatctctccctaggatggagctcctggcagggaggggcagcctccatctctgcagttcagtcaactcagtccttctagcctgttggctttgcagaatcccaaaatggtctggacgagaaagcctcctcataatgcagcacatttgctctaccaaaaagcagacagactgcttctttaatcaggcccctgatcctgttcatcccaactggatgagacctcccaacagggtctccagccacctcctacaggtgtgttctggccagcaacaggtcagtaccccccagggatggagcttccagaggaagaagctggctgccatctttgctgtttcacagccttcactgatgatacctccagtatgggaaaaaccgaggcaactaaggtctggagcggacttccagcaaaccacagcagccctacaataaagtggcctgactagtaaaggaaaaacaaaaaacagaaaacaacaagaacagtatcaatgaaaaggaccccacaaaatccaaggtcaaaggtcagcaagctcaaagattgaaggtagataagcccacaaaaatgagaaagaatcaacacaaaaatgttgaaaacttaaaaagcaagagtgccttttctcctccaaatgactgtaacacctctccagcaatggcacagaattgagctgaggctgaaatggctgaattgacagaagtagggttcagaaggtggtaataatgaactttgctgagctaaagaagcatgttgtaatccaatgcaaagaagctaagaatcatgataaaacaatacaggagctgacagccagaataaccagtttacagaggaacatgatcaacctaatggagctgaaaaatacaacacaagaccttcacaatgcaattacaagtatcagtgggagaacagaccaagtggaagaaggaatctcagagtctgaacactatctctcttaaataagaggggcagacaagaatagagggaaaagaatgaacaacaccccccagaaatttgggattatgtaaagagactgaacccatgactgactggggtacctaaaagagataaggataatggagtcaaattggaaaacatacttcaggatatgatccagaagatctttcccaacctagcaagacacaccaacattcaaattcaggaaatgcagagaaccccagtaagatactccatgagaagataaaccccaagacacataatcatcggattctccaaagttgaaatgaaaaaaaaatgttaagggcagccagagagaatggccaggccacctacaaacggaagcccatcagactaacagcagacctgtccgtggaaaccttataaagtacagtggttggaagctattctttaacattcttaaagaaaagaatctccaacccagaatttcatatctgaccaaactagcttcgtaagtgaagaagaaatacgatccttttcagacagcaaacacttaggaatttgtaccacaggactgccttgcaagagctcctctaggaagcactaaatatggaaagaagaaaaccattaccagccctacaaagcacactgaaatacacagaccagcaacactatgaagcaaccacataaacaagtctgtgaaataaccaggtagcatagtaatgacaggatccaacttacccataacaatactaacttttaagtgtaaacagggtaaatgccacaattaaaagatatagaattgcaagctgagtaaagaaccaagactcactgatatgctgtctttaggagacacatctcacatgcaaagacaaacataggctcaaaataaacggatggaagaaattttaccaaccaaatggaaaacagaaaaaagcaggggttgcaatcttagtttctgacaaaacagactttaaaccaacaaagaacaaaaaagacaaagaagggcattatataacggtaaagggttccattcaacaggaagagctagctatcctaaatatatatgcacccaatacaggagcacccagattcataaagcaagttcttagagacctacaaagagagacctggactcccacacaaaaatagtgggagactttaacaccccactgacagtattagaaacatcactgagaccaaaaactaacaaatatattcaggacccaaattcagctctggattaagtggaactgatagatatccatagaattcttcacctgaaaacatcagaatatacactcttctcatcatcatatggctgttgctcaaatcgatcacatatttggaagtaaaacattcctcagcaaatgcaaaacaactgaaatcatgacagtctctcagatcacagttcaatcaaattagaactcaagatcaagaaattcacttaaaccacacaactacatggaaattgaacaacctgctcctgaatgactcttggataaataacaaaattaaggcagaaatcaagaagttatttgaaactaatgagaacaaagagacaatgtaccagaatctctgggacagataaatcagtgttaagagggaaatgtattgcactaaaggcccactacaaacctctgctcaaagaaatgagagaagatacaaacaaatgaagaaacattccatgctcatgggtaggaagaatcaatattgtgaaaatagccatactgtacaaagtaacttatagattcaatgctattcccattaaactaccattgacgttcttcacagaattaggaaaaaaaactattttaaaattcatatggaaccaaaaaagagcctgaatagaaatagacaagacaatcataagcaaaaggaacaaagctagaggaatcatgctaccagacttcaaactatactttaaggctacaataaccaaaacagaatggtgctggtacaagagcagacacatagaccaatggaacagaatagagaactcagaaataatacgacacacctacaaccatctgatcttcaacaaacctgacaaaacaagcaatggggaaaggacttcctatttactaaatggtgttgggagagttggctagccaaatgcagaaaattgaaactggactccttccttacaccatatacaaaaattaactcaagatggattaaagacttacatgtaaaacccgaaactatgaacaccctagaagaaaacgtaggcaatctcatttaggacataggcacaggcaaagatttcatgacgaacatgccaaaagcaattgcaacaaaagcaaaaattgacaaatgcaatctaattaaactaaagagattctgcacagcaaaataaactatcatcagagtaaacagacaccctgtagaataggagaaattttttttgcaatctatctatctgaaaaaggtctaatatccagagtctgcaaggaacttaaacttacaacaaaaaaacaaccagacaaccccattaaaaagtaggcaaaggacgtgaacagacacttatcaaaagaagacatacatgtggccaagaaacatttaaaaaatagctcaacatcactgatcattagagaaatgtaaatcaaaccacaatgagattccatctcatgacagccagaatggctattataagagtcaaaaaacaatggatgctggtaaggttgcagagaaaaaggaacacttttacactgttgtgggagtgtaaatgagttaaaccactgtggaagacagtgtggtgattcctcaaaggcctagaggcagaaataccacttgacctagcaattctattatggggtacatacccaaaggaatataaatcattctattataaagatacatgcatgtgtatgttcattgcagcactgttcaccatagcaaagacatggaatcaacctaaatgcccatcagtgatagactggataaagaaaatgtggtgcatacaacatggaattatatgttggcataaaaagaaatgagatcaggctgggcacggtggctcatgcctgtaatcccagcactttgggaggccgaggtaggcagatcacgaggtcaggagattgagaccatcctagctaacacagtgaaaccccatctctactaaaaagacaaaaaattagctgagcgtggtggcgggcacctgtagtcccagctactcgggaggctgaggcaggagaatggcatgaacccgggaggcgaagcttgcagtgagctgagatcgtgccactgcactccagcctggatgacagagcaagactccatctcaaaaaataaataaataaataaataaataaataaataaatagaaatgagatcatgtcctttgcagggaaatggatagagttggaagccattacactcagcaaactaatgggaacagaaacccaaacactgcatgttctcacttataagagggagctgaatggtaagaacacatggacacatcacagggaacaagacacactagggcctgtcagaagacggttagtgggagggagagcatgaggcaagaaaaggtaatgaatgctggcttgatacctgggtgatgggatgatctgtgcagcaaaccaccatagcacatgtttacctatgtaacaaacctgcacttcctgcacaggtgccctggaacttaaaataaaagtcgaagagctccctctccctctccctctccctctccctccccctccccctccccctccccctgcctctgcctctgcctctgcctctctgtctcccctttccacggtctccctctgatgcggagctgaggctggactgtactgccgccatctcggctcactgcaacctccctgcctgattctcctgcctcagcctgccgagtgcctgggattgcaggtgcgcgccaccacgcctgactggtttttgtattttttggtggagacggggtttcgctgtgttggccgggctggtctccagctcctgaccgcgagtgatctgcctgcctcggcctcccgaggtgccgggattgcagacggagtcttgctcactcagtgctcaatcttgcccaggctggagtgcagtggtgtgatctcggctagctacaacctccaacctcccagccgcctaccttggcctcccaaagtgccgagattgcagcctctgcccggccgccaccccgtctgggaagtgaggagcgtctctgcctggccgcccatcctctgggatgtgagaagcccctctgcccggccgcccagtctgggaagtgaggagtgcctcttcccggccgtcatcccgtctaggaagtgaggagcgtctctgcccggccgcccatcgtctgagatgtggggagcgcctctgccccgccgccccgtctgggatgtggggagcgcctctgcccggccacgaccccgtctgggaagtgaggagccctctgcccagccgccaccccgtctggaggtgtacccaacagctgattgagaacgggccatgatgacgatggaggttttgtcgaatagaaaagggggaaatgtagggaaaagaaagagagatcagattgttactgtgtctgtgtggaaagaagtagacatgggagactccattttgttctgcactaagaaaaattcttctgccttgggatgctgttaatctataaccttacccccaaccccctgctctctgaaacatgtcttgtgtccactaagggttaaatggattaagggcggtgcaaaatgtgctttgttaaactgatgcttgaaggcagcatgctccttaagagtcatcaccaactccctaatctcaagtacccagggacacaaaaaccgcggaaggccgcagggtcctctgcctaggaaaccagagacccttgttcacatgtttatctgctgaccttccctccactattgtcctatgaccctgccaaatccccctctccgagaaacacccaagaatgatcaataaatactataaaaaaaataaaaaataaaaaaaataaagttgaatcaaagaaaaaaaaagtcgaagaaaaaaaaagaagataaccatttgaattgcctcatcaggtggcttgttatgggagaatgtatatttccaagactcttgaaattaaagagagtgagctatcataaacagtgagctcctagacagaaataatttagagtatgtgatagtaagcacacctgtcaaggctctctcctttgaagaaaatgtaatgaggaggactctgaaagaaattagagcatgtacacacaaagattcaaaatcaatcaacattattattacaaaagctgagagcagaattaaaagaatgcctgtgcttggaatacttgttatggagaattttaatttgctaagaaaatggatgagacactacagtattttgaagtgatacttccttctgatcatcagaacaggagcaaaggaagaatatttaaaattgaaagcttttatataattcttactgtgttttgggcatttcaagtgggttcattttccaagtagaaaatattcagcatctacttagaatgccttattttatggaagagtaaactgaagtagagagaagatacataattttcttcatgtcacatggctagtaaatggaggaaagagggattcaaacacaagaatttggggactggattccttttaaccatttataaactattataaccaaaattaaaaatataggttcattaaaatggaagaggaacaagacttccttaggaatagttctaacttcttagaagacatatttctcatatgaaagaaagaggaggttctcggccgggtgtggtggctcacacctgtaatctcagcactctgggaatttgaggcaggcggatcacttgagctcaggagtttgagacaagcctcggcaacatagtgagatcccatcactactaaaaataaaaaaaaattatctggggattggtggtgcatgcctgtggtcccagctactcgggaggctgaggtgggaaaatcacttgagcctagggggtaggggttgcagtgagccaagagcatgctactgtattccagcctaggtgacagagtgagacctcacccccaattaaaaaaaaaaagaaagaaaagaaaagaaagaaagaagaggctctcatatccaggaaagatcaattttagagggaagaggaaatgcactcagggtcaactgctctcaaggagttattagaagagatttattttggttgttactaaggcaggcaagataactggatgtaaagaatcttcatggaggaaaaacaaagatacaggatctcagaggggagactagataaactttacagaggaagacaggatttggggatttgttaaggaatgacttaaaatcaacactatataaagggttatatgcaatttggacatttttgagaagagatgccctgagacatcaattgaagactctcaaattatttgatgttcagctctagcctgtgcttgaaaggagcctgcttaattatttttaaaattatgagtcttaagaaagtgtaagaaagatggaacatattaaaggaaaagcaggcaaacaaaaaatgagaataccttttagatacaattgctcaaccaaggaaattaaagatattcaatatttatcttaatagtgcttgctttagaggatccagacattgttaattgcacatctctcaatagagaagaccacagagatcaaatctagaatattttgaaaagactagtgacaagtacaaacataaaatttaagaaggaatttaattctagtgaatattgctaatactacatgtgcttgagaaagaacaggacaaatttacaaagcctttcaaacttctagaaattcagcttaagctagaccaggcccagtggctcacgcttgtaatcccagcactttgggaggccgaggcgggtggattacctgaggtcaggagtgagagaccagcctggctaacatagtgaaacctcgtctctatgaaaaatacagaaattagcttggcatggtggcacaagcctgtaatcccagctacatgggaggctgaggcaggggaatcacttgaacccaggaggtataagttgcattgagccgagaccacgccactgcactccagcctaggcaacaaaagcaaaattccatctcaaaaagaaaaaaaaaaaaagtagtgagccaactctttattcagtaggggatcctgtccgctaaggaaaaggtaatggaagggcatattcgattcaggagaatgctagctagcccaataagctgcaaagctcagccccttctttaccagaatcaaagctcacatttccacttcagttgatctgacatgagtatttttctctcaggtgttttgaatcttaggtcagaaagagtggttacccctgcgcatgaccactgtgccaatgtaacacagcatatattactttgggtcttgacaaagggctcatttttagtgactgagtccttctggccaccaggagacacttcagtgccacaaccactcactgacactttagagttgctaagaggactgtcaggccatgggaaactaagaagaagctcaggcttggtacctgaatcatgagtcctacctgttgagcactgaaaaagcactggaaagagaagggaggacccaaaaacttctaaacctgtgcgaatgggctaagaccaatagtgaggttgggattttaggcaagtttgggatggttgtcagacaaagaagccactgatataccactagtacaatgcagttcgaattacaataaaaagttatagggggtttttttgggtcagaaagagaagaagtaaaagagcacacatgattcctatctccttttatcctccaaactaactctcactaacccacagaaatgttttcataggtggcacaaaggtaggctgcaacaattgtggccaatattatggtagagaaggaccctgccctgtaatgctcaacatattaatgttacgtgagagtgggacagggtcatctctgtgacagtatagtcacagaagcctcttcctgctcaaataagtggccttcattaaaagaaacacagaagaatcttgtttcataagctaatgccaatcactgagacagcaacggtttcaggaacatgagggaagctgttggaatgggctttcctttaaacctagcctggttccatcatgctgagtggtgggggctttaagtcagggcctgagaaggacagcctaactgtggtataagtcagagggctcctcattcctcataagccgacaaatacattaatatcatcagaaaaattaccagggcctgtggtgtcccaaattctgatttcattttccattgaagatcagagcacagaggaaggagatacctcactcatgtgctcttcttgttatatgctcacagtttctttgtttcaatgactctgtaccctggaagaggttagacctggatatgctaaaaaaaaatttttttaatccctatcctagaatattgtggccttgaatcaaagtgttttctatgtttgtgttttcatcttccttcctaagccctatatctaggttttgccttctccatccacaaatctcaggatgctatggagtctgaagacacctgattgcagaaagcacaagaccccccaccagcgcgcgcacatacacaaacaaatacaggaccagaaaggagtggttactgctgattctctaacattacaaaaatatcacggttgtaacttctcaccctgccagtcatatgtttctctgtcacttgacatactcccctctttggggtgttggaggaaaaaatctctgtgccaacagcagagacatggaactagtgtgtcacatccactctatgaacagaattcttactactatttataccctaaaaagcaggccattttctagagtttcaccccctcaccagaaagaatttatttgtgagtattggttgacttactataacaagagactcaagtgttaatcattaaaggaacctgttagtgctttcttagaagtaagaggaagatcacatttaactggagagtgccttattgtggttttcaaggaaggtcaaagctcttacttatcactgctcaatcttcacccgatgcccaaagaattaacataattttgaaccttaccctggagaagcgaaatgggaccttgtcctccagaaatgcagaagacactgtgctgtgggctgggggagtcacggagcacgagagtatccatctccagccctcactggaaataaaatctgcacagttctatctctttccagggcagccaccttgttctctgcatgaggagcatggaggtccagatgcttccaggagggatctggggcaaagctctaactaagcaacacattattttgattttgtgtgtctgggatataaggatggccggtaaggggaacaataaagttcttgagatttcacaagtaatttattgatgtccagaatttgaggtgctgatggtacacctaagtggcaatatgcaccaggcagatcaatatgtgactcgtcagagaaagcagaatgggtgatgtgatgtgcaatgccacagaagcactgcagccaggagaggtgacagctaatggggatgtttggagtctttgagtgaaccaaacacatcccagagtaattgtaatttatttcagtcaatcttctgtacagacttagcattcacctttggaggaaggtcctttgagcagggacagagatggtgatgtcactgacagtcccccttttactctgggtgagaggtctagaatcctcagctcctgtattcgtgcccacaagggcctcatctaggtgaaggctccacctgccccaccctgccatggccaccaggctcctctgctgtgtggttctttgtctcctgggagaaggtgagtccccacaaataaagcacctgcatttttggatattgccagttatgattccaattatgtttcttattctgtccccaaattctatctcttttcacagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggtcacagcgctgcagaatcacctgctccctgtgcagaaaccctggtgcttcctcttctcctccagtacccagcagctctcagcagcctttcttgctcctcccctagcacaggaagtacataggtttcgtgttccacatgtcctaggcaaggcaagaacaggtcataaggacacatcacgttaggaaacttttggtaggaagtcagtgggtgtgatggttcctgggattccacacatacttctcacaagggtgcctgagtccaagtttgagggcgagtgtcacagactggagctttcaagtgattgagtgagcttaaaactgtgcagccattgcacatggatgcttatctcctttgctgctttccgttatggcttctttgccatttcttttctcttctaccttaaaactttcaacatctttgatgacttccaacatcaatattggcttcccagttttttcacttgctcacttcaaatgatcatttccttcaccttgtgtcagatattcatttccactttctttttctagattccaatgacaaattatttgaattacccccaaatagtttcctcaagcatcccattgtctcatgcgggcttctcttttcatctctggtactacttctgcagcaattcttcaacccatcaggaccactaattgacttctcctgcaaatattgcaccatatatcatctcctcatgtactatattccttatctgacttagactatgtgttccaaggtgattgtgaaattttgcctatgtcttcagctcttttctttttctgtttcttacctggaaaataaaatggggcctactctgtgcccctttcaatgacacagagaacataaaatgtcccttacccttgtcaagcagtattataacgatacagtgtgtcttgaggtctgtaagtccctctatgcatataaaattatatacttttcttctattaaaataatttgttaccttttaatgagttcatcagtttcatctttcaattatagttatacttttgacaattatagaagtactaaaaaaagttatgcacccagaatgtatgattctatcacttttatgtgtgtgcgcacttcacttcatacgtacaaaaaagttaaaagaatgccgaataggcatatttatccattctcttgtaggaatgataaagatgaacttccaaggggaaaatattttcaaaataatccatggcacataaaattatttaagaaaaaataaatcaataaatatccctgttaagtttatatatagttttatatgcttgggtaaggaagaaaaaaagttgtgatatattttgctggttatttggagagataaaatatagaaagagcagaaagaacatgattagctttgtctttgtttaaaatttttgctttttaaatttgatacactatttaccatcaaaatttaaaacaacaccactgctataaaacaatatacagacaaactaaaaagaaaaaggaatttactatgtaaaaaaaaaaaaaaaagcgagagcttataggcagagtattaaggggaatttaaaattataaagacctgtaagttttcagagaggtataggcctcacagctggagctgggattttaatgtccatatgaaagagatgacagaaaacagccagaattacattgcttgccttaatcctggagcttcaaaatgctcccaggctttataaagtaaaagtattacaccccaaagacccagaaacataattggaaactggatgtttggtcaggcctttgggtgatagataaaaaggaaaagttaggagagaaaaattgaatcttcagactgtgtctcacatgtgtttggaatgaaatatactctgcatggaatgtacaccatatacccaaaaactgacaaaaaggtccataaccattaaaacccttggagaccctggcattaagagattcaatacggttctggagtaaacttctgcttccaaccaagatagattaacgggaattagatttaacttcttgcttgaaacagctaacaccccaacccccaccctgtccccctgcacacacacattcacacaacatgtggaataacggttgtcaagacattggaagtaggcaacagaagacagtgatctctgagagatggaaacaaccaagctgagaactatgactgtcttaatacctggagggagtttccaggccctgggccagaaagaggaatccaagcagagctgggtgatctcactgagctgagtcagagttggaaatacaagatcaaagcagctagatttcacatgacaggccattgaaaaggcgattgctgcacagagagaatcctggagaccttcctagggtctcccttaacccttcagctgtgctgtaagcagtacatgtgtgaggaaactccctaaggttggagaaagagccactcagcaagattagaggaaacaatgcctggagctcacaaagggctgagagtaatatatacatatattactctcatatatatatgtatatgtatatttttgcattgagaatgggaaacttaataattcatgggtcaatcagtagaggtttcagatgacttatgcctcagtataaaagcaaaataagcccttcactaaataagccacatttggctcctggcctatgtgggtgagacttcaaaatatcaaactgtttccgagtaacttaagtctcagagcaaaactaaagaatatttctaatgtacaagaatacctgttcggagatatcagtatgaatttattgtttttaaacgtatagatacaatggtaaagaaatgaatacatacctgtgtgaataatgggttggtatatatacatgtatttcatacttctgtccacttagaagaccactagtgcacagatgtttgttgccaaatattattctccaattaaaaaaaaatgaaaggtggttctaggaccctgaggtaaaaaatacaagaatgttgtaatgaggttttccaaaaaaaaaaaaaaaaaaaaaggatgggacatatctcaaaaggacagaggaatcaatctgaaagagcttccccaatgactaaggctggaacaatttgtaaaagaaaattcacaagttcacactgagaatgaaacgattaaataaataaataaataataaaaaatgtgagaaaggacaatctcttactgaagaattccaaattgcatatgtagaagaaacagagggaaatagaaaagtcactgtgacaacaccactgtgagtaactgccacacataaaacccaatagtgagtgctaaaattagtgggtgtagctaattttaattactaattaataactaataactttaataactaattaagaagaaatggatcatttgtacagtcacaaagtgtcatccccaaaatattaattaatatggtggttttaacatatgcccacacattcttttatactcatccctctagattcccctctcctggattcagtggcctgcctctaatgaacagacatgggaaatagaaaaatggtaaccgagtgatccaaagtaaataaactgacccataataagtcttgttaacctcatgtgcattctcttatgatgcaatgttgtgatgttatcatgtgactacatatctgtaatattcctcccccaaatctataattcctgtctaataatgagaaagcatcaaacaaatcccaaactgaaagagattctacaaaacacctgaccagtaatcttcaaatgtcaatatcgttaaaaacaaggaaagagctgtcacaaattgaaggacactaagaagatatgacacttaaatgcagtatgggatcctggattaggtgctagggcaggaaaaggtcattattagaaaaactggggaaatctgagtacagtctagcttagttgtgccaatgtcaaattcttagtttgtgtgatgttagcactagtgggtgttggatgaaggatataaagtcacttggtagtattgttatagctacaggacatcaattctccagctttgggtcacctgagtccctatcaagccaatttgtgaagctgctgttagttgtccttactccccagtcttggagctctcagttagacctagaatcaacctcttcttcctcttgacctctgcttcactgcatcctaaacgtggtgaggtggaggggtggtgagggaggctgagcagaagcccatcattcagaagcccatcactagagcttctctgatgattctctgagacaggggctccctctgtagtctcctttgtgcacaatcccaagcacgctgggccacacagactccaccaaagctagttttgtgaggaggcaaatattgaggctccattgtgaagagaatgtccatgtcagatttaagtacaaaagattaaagttgatgcattactattgcaggaaaatgatacctgtgagaatttccaaaagccagattttgtattgtgtggctggctgagtaatacccctccccacaaagacattcacatcctaatccctgggatctgcctctgttaccttagatggtgagagtagactttacagatgtgatgaagttaaggatctggagataaggagattattttggattagtctggtggccctcaatgcaattacatgtgtccttataagagatagccagggggagatcagacacaaatggagaagagaaggcaatgtgaccacaggagaagagattagagtgaggtgaccacaagccaaggagtgaggcagccactagaaacagaggcaaggaacgaatcctctcctatagcctccagggggaatacggtcctgatgacacctggattttggtccattgatactgattttggacttttccagaactgtgagaataaatctctgtcattgtaaaccagcaactttgtggtaatttttatagcagccactcaaaattaacacactccaatatgtccagttaacctgagactaggccaagaaactcatgttcttataatattttctgcaaaccttgctgtcatgtttttatctgacacccatctcaaactataatgaaagaaaataattttgagacttcaatgtccccctgtctggggtgtgccttccatagttcattggaaaagtctagtctcctttcaagattttattccagcagtacctcctcttgaaagaattttaggcattgttttctgttctcagtgcacatactaaaaagaaaaagacaaagactcatgtctacttgatgtttacatttttgcggggagggagagacagagataaacaaataagtaaggcatatagtgtattagcaggtgatacctgcaatgcagaaaaagaaaaggcagactaaggtgagggagaccaggactgtcagagtaaggagcgttgaaatgacaatacattgttcagagtagggcccaatgaggaagtgacctttgagcaatgatttcaaggagatgaaggaaagagacatgtaggtatctgggggaaaagaattccaggcagagggaggagccagtacaaataccctaaaaaaatattttaggaccaatgaggaggcccatatgactgaaaaattaaggaagggagtggtagactttatttccaagcggtaatggggcaggatggatcatttaagaccttgatggccttaagtgctttgttgttttgttttcttattccaaataaaactgggagctagtagatgatttggagatgagtgacatgatctagcatgttctagagggctgagtttgagagctagttcagaagtaggtgaaagcagggagatcagttaggaatctattgcagtaatccaggaaaaagatgatggtggccttgtcctgagggttagcaaagaaggtgatgaaaaaatggatggattctgagtgtattttcatgatagagccagttgaatttcctaatggattggctatagggtgggatagaaaaagaggatttgggaaccactctaaggttttcagctggaaggctgttggtggagtaaagttgaggataatctttcatgtttagagcatgctgtttgagagtggtggggggaaaatgttgattggagtgcattagagagataatgggaaaagagaatttggaggtaagtattgatcattagcaatagcaacaatagctaccgtagattaaaatgccccacagtctatggggatgtgatacatgagggaagacagggccagatgggatgaggtaggatccagacatcagactcaggagctacgagtggtatatataaggttaacacctagtcaaatgcataaacaggttgattttaattgatgtcagtttttctccattgccccctctagaggcaatcttcttcagagaaccctggctaggtcttctatgtttcatgtccgtagagggagctcctgagactgtggacattggctaatatgctgatgtcactggaggccacatcttacagggccaagagacagatttgctttcctttttctcatacttgtaagctccttcatctggaaatgtgatttacctgggtcctgccatggtttccaggcttctcagtttagtgtccctttgtctcctgggagcaagtgagtcttcaggtacttaaatatctgtgctgtaccctatcccagtctattcatgtcatgtattctgtttttgtctcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaagacacagtgcttcacagtcgtgcccttgctgtgcaaaaccatagccttctcctctcaactcacagctgcccaaaaggaaggctttccctgtgccttctcccccaaggaggggagataaagaaccagaattaactcatgaaatacaagagtattccaagaagatttgggtgaaaatacttgtggtttgggggatctctgaagttttttaaacagaactcaaactatgtgtttctcatatttatttttattttttaaagtgtatgttgcctggttataaagcagacttcttgcctatcttgctgctctgaaaggtttgtgactctgactgtgaggccacatctttatatcccttcttatagtaagagaaacaagtctttctgatgaaaataaaaatagtgaataaaaatgcatttactactggcttttaggatgctcaatgatgatgctagcaatggtggtagtggtgacgttggtaatggtggtgatgagtttaggttgcttttgtctagcatttataaatttccaaccactttaaaacaatctcattttagagtggaatagctaagtccattatcagaggttaatgctaattttctgttcacatagggtctgagtttttaatgtaaaaaatatagttagcactataaatagatatctgtcagccgatacagaacattttttaagatcacttccagttgctgcaataggaatatgtattcctattttttttcttttttctttttctttttttgagacgaagtcttgctctgtcgcccaggctggagtgcagtggcaaaatctcagctcactgcaacttctgcctcctgggtttaagcgattctcctgcctcagcctaccaagtagctgggattacaggtgcctgccaccatgcctggctatttgttgtatttttagtagagacgggatttcaccatgttggccaggctggtcttgaactcctgacctcaagtgatctgcctgcctcagcctcccaaagtgctgggtttacaggtgtgagctactgtgcccggcctttttttctttttgagacagggtttcattctgtcaccccggctggagtgccatggcagtgtgatcacggctcactacagcctcgacttcctgggctcaagcagtcctcctgcctcaggctccctagtagatgggactataggtgtgcatgaccacacccagctaatttttgcattttttgtagggacaggtctcactatgttgcccaggctggtcctaaacttcttggctcaagtgatcttcctgccttggcctcccaaaatgctgggattataggcataagacaccatgcctggcctggaatatgtaatttttaatgagacctaatggtataatacattctacctggttcaactgccttcttttaatatctggattccaatattctgctcatgtttcagccatgtttttgcaaacagtcctgaaattcactctaataataagtttcattttcccagtctgattgttatttagcacctcaaattattattgaactcatcctaatcctgattaggcaaatggatagtgagaaaatattacaagtgggcttggattttaattttttcaaacaatttaaaacccattttccttttctaatgatcaagatccaatttttagataatcagtactctctctttctatgtggacatgtaatatgaataggtatattgtttctgtcacaggcatcgcaaactcatatcttgcttgaaacttgtcgatgaactcctttagtatgacaagaacaaagagaaatagatttttaaagcatagccacatattggacatgagtttttcttcaaaatttcagctgcagaaccctaactggtgcctttccttttattgtgttatgtaatctaaggtcataataagtaactaaattattgatttatttttccactctgtaatctctccattatatttaaaaatagcagctatgaagcaaaacaagttcctcgttgggtacattgcctcaactccaaaatctaacaagcagaagtttaattcagtgctttgccatttcatactatagacaccgaatgtcctatcctataaggggcacacagtggttctctttatagttctgttagctcaagtggtatctttaggtacaatttttagaatttttttatttgttaatctttcttaaggtatgattgacagaaaaaaattgtaggtatttaaggtatacaaggcgatgttttgatatacatatacattgcaaaatgattaccacactcaagttaattaacatatccatcacctcacaaagttacctttgtatgtatatgtatggtgagaatgatctactctcagaaaatttcgagtgtacaataatcattaactatagtcaccatgctgtccattaggtctccagaactttcgagcacactccaaaacatcaacttttattctgattaagcctcaaatatgtcttcttgttgcaaatattagctatttttagattagctataaataatgaaaaatgctagcataaaagatggaaagaataaatgcagataagggctctaaggtctttacactttccaggaagtgataaaagctgcaatttaaattatacatgaagaagtcaaggatggcaactcctataaacagctgatacttcaaacctggaatgtctagtgctaagcagcccggacccctgcacccagcacacctctctttggcatgataggaggatgagggatccaggtcttctcctcccatgctgcccttggcctttatgttttgcctttcattagtaaggcttctcccttaattatcaccctatgacaggaaattcatcctaagcctggacacgtgagagatggtaactctgaagcagccccctgcggatgacaccaaatgaggccacacccagaacaaattgcaagaaataacaaggtatttcttacagaatccctaagagaacatgtctgtctgcatttaagtgtctacagtcataaatgcacagcatatgattggatcagatggaactgaaagactttcagtgcttcatggtgcccataactctcattgtcctgaagtggtgttggcagtggactcagcagggtgccgtgagatggtgaggctacacacatacgatcgtgaccaagctggctacacagatgggccaaactcaccctgtgatggtagacagagcttaccaatgggttccatgaatggacaatgggcatgctgctgtaataatcccttcgaccatgatggaagtcaggcaagacccaggccatgggaacattgaaaacagtcacctctagcctcaagtatttcctactgtttgccacactgtgcctacaaatatcatttatgatacagcttaaaattttcatgtttgtgaaaattattatcagccttatccaatctgatattttgaatgaaatcacattaaaaccatatattaatttaagaactggcatcttcataatagtgagtcttctacagtttcctagaccactaaaaaatcatggattgctatctcagacttgaaatgggtgatccttattcttctctcagtcagaacagtgaaaggtacagattcatggcagctagtccagcttctaaaagtcaacttctaattgtctactttaggacaaaaaagaaataatatccttaggaaggccaccatggaattcattctatctgaacaatccttacataatatcatttcttataatatgtcctcaacatcgtgctctgcatatatttctccaccatctctaaaaatcctcttagcccaggcctcctcaaactttaatgtgcatgtaaattatgaccttgttaaaatgcagattctaatccaatcagtcagggttggagctaaggttccctgtattttgaacaagagtccgtccaagtgatgccaaagctgccagtccatggaccacaatgagcagccaagctctagatgacacctacaataattacaggtgtaaggcccctcttctcaagtatcattttgcacagttcctggactaggtcagatacagaccctacttaccacatgtatctctgtattccaagtattacgtaatcatcagttttcctaaatctaggcaccaatattttaacatatattttcatggtataaatagaaattaattttctatagtaaatacactaatacctaatcacattcatgcatctttaatgtgagtagcaaaaagccaaggcactatcttaatggttattgagtgagactttagcaaatactatctttatggagaaacctctgggctgctttttaggatgtgagaaaagtgaggtaaagtgaggagaactggatgaacacgggacagagacagggacaggggcaaatatggggacacctgtctcaaggaagcagcaaatgatatagaaaataaatatctgttccatccctgttccagacaagcccatgtacctgccaagtaggaagctgtgtatcacattgcaacaaggaatgaccccggccctggtaaagtcaacagcaacagtcatcacaggccaatctgcctatcagggactggagactctctaaactcccacctctcaacccaggaatcagagcctgagacagacagatgcttcattcctgtatggggtggtattcctgccatgggtcctgggcttctccactggatggccctttgtctccttggaacaggtgagtactgggcagaaaggaaatctttgagcaaagctatcttgtcctcagtctgcacctttcattcacagcagtaacactgttctccttaactctgactccaaatttgtcttctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagagacacagagctgcagtgcttcctgctctctgttcataaacctcattgtttcccagatccaggtgctttctctaggacttctccctcaccacctcttacaacaataggaagtgggttggtggctgtcaatatctgtagacagaagttgagcacaaaccaataaaaaccattgacagttatgccaagagtggaaaagtggttacacatgcctggcattcagttggtggtattttcccaggatcacatttagaacccatgctgtccttttcagaagacaaataagaactttttctttctttttttcattgttttaatctaagtcagaggcttagaaatataagaggtgatatgtgaagaattatggacacccaatgtctatgaagtccagtctctggcattcgatgaactcttataggatttaatcctcctggagaatccacatgtttttagcctagacctggagcaactacctcattaatgggagaatgaaagcacaagtatcccaagataaaaatttctcagaggtaaaaccacattggagagaaaaaaagagaagaccatacattaatctgctcatatctggagttggaggtactattgagatgagcaaatggaaaccataaatacataaagaaatgatattgaaaatagagtacatttggagatgaagatcatggagccatctgtatagaagagagtaataatgtcattaaggtgcataagagtgccagcaaatgtcaataagaaaaactacaggagggaagaagatgggagatcctgctccccttaacaaagataaataaaatgctgagtgagaaatattgcaacctcataaattgtcacatggaagtatgtatttataaattaccattataattaacatccctcaatgagaacgatattctgagaaaaaaaagcagaaaatatagttatatggctatctaaaaatgtaaaattttgcacattaaattaagataatctaggaaaaatatgacaagacctattacaaaagagcttttacaaattgtttgctttaatgatattaataacataatgatagctaacatttactaagcacatattacatgctagaccttaagtcttcttcacatatatttatagttcatgttagttttataacaacctcagaaagttaatactatagtaacctcactcatttatccatgaggaaactgaggcacagacaagtaactagccctttatcacgtatctcgtttgtggtggagccagtatcaaaatgtagacaatttactgctggagctcattctgtcttcggagtttacatggattctaagtcagaccttcagataggaaggtaaatggttataagccagaagatttccacactctcaccaacattgcactggcttttctttgggtcttggccagagggtgagcccttgtgactatgcttcactggttgactaggtttgagttgcaccgaggaccaacatagagaaagaaggtctttgggataaacctgggaggatgaagggtaaaaaatgcagaacttaaatcttgatcccaagggatcatttaaagatgaatgagtctcccttagaggatgagaaattaaacataaactctttaacttgcagagatgctgaagtgttttcctcaagtagtaaactttgaatcatggttatatgcatgggagggagcctatggggatggaacatggatgaaaaagtgacaggatgttcagggggcaggtgcgggcagaaaatcagctgcctccaagagtggtgagagaagctgtagagcatcctttatccagactggcacaacatgcagtccagaaggctgtgagatacgaggaaagggtcaccataaactgcaacctgactatgtcaaaaatgacacttggaatccgagagtgggtacgtgtggtggtatcacagatatacacccaccccatccccgcccaactgggagataagagacttacaggtttagcactttcaccactgggactagaaccctggatttagctagaggctggcttagaccttttcatggttcttctgtatgaaccacacaatttagaaccatactatttagagatgatcaatttatacgacctgcataaagcctgtctttccagaagaagctcaggttcaaaaaaaaaattgattcctctcttgtccttctcaatcttccctccttccttctttcctttcttcctgcctgcctgccttcctcattaaggatagacatgaactagtcacctgtatactctctgaggtatgctgttagtgctgacaacacattagttcaacctagaaaaactaaccctgttttattttatcttatctgagagtctgagacccctctttgatccttaaaaacttgccaatttcttgccaagcaaatatgtgcagggttttagagagccgtaggtaacagagacaaaatagaaacaacacacagaatttggagcaaagcctttagatctctaaagcttgaggccccactgctgctctaagcctgcctatggcaccaggttcctctgctatgagtccctctgcctcctgagggcagtgagtcctgggcgtagatagtctgtctgccttgggcactcacactgtagtctgtttccacaccttcctctggtagtccaatattcacccccattttcctctctagcccctgctcctacactctagtccacagactctgtggatatcctaatcacagagacagaaacagaggtgacactcagatgtgagtgatgaaacttacaatgctgtaaacaagactcaggacttagactgcctactgatgttcattcttgtgccatttgttcagcaaatatgtatttaggaactcctgtataacagaccttgtttccggttctggaaataaggtaataaacaaaccagagagacttgttttaaactcctggaatttataaaccaaagagatgtatgtgatgagaacagtacgactctggataagaaggaacctgttaccttaacactggccagtgcaaacccagtctggcagacatctgtgatcctctagacttgtaaggaatcctatagctgtatagctctttgcatttaagggcaaaactagacaagacagaacctcactctcatgaatccatgccctaagaaagagaagaaacttccctcataggaacattggtgcagtctcgcagttttcttatcaagtaggaaaattagaactgctaaaactttgtgccagaatttaagacaaataaattgcctggatcatgcattatttacaattatatttacaattatatacagatattttccctaatataaatctgttgatgaaccacttatgtggcatataaataggacttattaaaagttagatgcggtgctttagaagatatattaaaattattagagtctgacttaaatttttaatagtaatacaaaatataaagtaccacagccttgttcagaagaaacaggatttctgaaatccaccagaatagctttctaaaagccagtatcttatggcctttagtgggctgaaatacttataatgatggattggaaaaatggatgtttgagtgcataaggttcacgagtataagaaacaattggtacctcctaactatagattgtcagtttcagaggatgagaatgaatgtgccctcatcctcattttaattttgaaagacaatgcagatatccctactatagaatcattttttacatcaccacctatagagattaacaacatagatgtttccagctccctaagaggccaagaagtattaacccaaggtcagattcaggtaattgatcgtgactcacgaattttcagagatccacaatggttgtttttaaattttcagcagttatgtctttttctctggggagagggtattcaaagctcctcatgaggccattctggactacttttcccctcctgccccctgcccataaaacagtttacagaaataggtgtccagaccgtgggctgtagttcaccaactcctgctctagcctaattttgtctcattactagagcatggccattctgtggatgccagtgaagcctttctggggtttctctccaatgccttttaaagctttttcctacacagacacagtttactgtttagccaaaaaattaagataattcctccagacatctggagttcttgtgcagcttcctcctctctggtggtctttccttaaaaattctagctgcctcagcccccgctgattttgtaacctgtttccgcaactcaaaatttgccatgctctgttgctctcttccccattgtgtatgtgcagaaattgcccccatgttttggtgttttggcagaatcccagtcctgtgctgtctgctttccagtggctgaatacaattgtttcacatattctcttaatttgtgttacttgtatagagcaggatgctaaaggcaattggattctacaaagtgatcacgtcacagagaagccgccgacagaggtggagagagccacacagatagccagctgcctgtgctgcctgctcttcccctaattctgccatgagcccaatattcacctgcatcacaatcctttgtctgctggctgcaggtaagtccctgttctgcagttgtcagctccctgctctaagcctttcatccatgtcatcgaactccctcatgggctcagtctccaactcctgtctgctttctttacaggttctcctggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacaatgttaaatattagctaatcttaggacacagactcatcacggactcagctcaggaagcaggtggtatactaggttggaaggaaataacagaaactagagctagcttaagccaaaggggaatgtattataaggctaaatgtatgtcccatagaaccacaaagcaagaacacaggaacttcccagaaataaactgcaatgaaaccttagaaccggtggtcgcgcctgtaatcccagagctttgggaggccgaggcgggaggatcacaaagtcaggagatcaagaccatcctgactaacacggtgaaaccctgtctctactaaaaaaaaaaaaaaaaaaatagccgggcctagtggtgggcgcctgtagtcccagctactcgctactcgggaggctgaggcaggagaatggcgtgaaccgggaggcggagcttgcagtgagccgagatcgtgccactgcactccagcctggacgacagaacgagactccatctcaaaaaaacaaaaaacaaaaaaaaaccttagaaccatggcatggctgattgacaactcattttttatataccttgtcggcctcattattctcttttattataagttgtcttttctgtttcttaggtcttacagtgattagaaaattgcagatttaggtgttagccctccagtcaattgagaccaacgtgactttctctcatgctagattacaaatccagggtgcagggggaaaaaatgtgatcctgctttactcaagaatgggctcgtggaaatccaagggaattgaattattttgaacaagatagtatctgggagtctgtccctctgaccttgtggaccaaggatttcaaggggtggaatccagtcagaacatccaataggcacccatcacaagtgagaagttggggataatacattttctggaatatagagaccttgggaaaagagaagagtttggagaggggatcaaaaccttattatttagaacaatatcagaccacgtaaagagtctggttaatctctctttaagaaattaaaccggccaggtgtggtggctcacggctataatcccagcactttggaaggccaaaagcaagcagatcacctgaggttgggagttcaagatcagcctgaccaacatgaagaaaccccatccctactaaaaatacaaaattagccaggtgtggtggcacatgcctgtaatcccagctacttaggaggctgaggctgaagaattgcttgaacctgggagggggaggttgtggtgagccgagagcgcaccactgcactctagcctgggcaacaagagcgaaactctgtctcaaaacaataaataaataaataaaatagaaggaataaaaagaaattaaacctagataacacaaaaagcatgttcattttaagtgtgacaacttcagatcctacaaattcactaattggcctctatggcactgaaggagaacagattaatgtactcttggtgtaaaacatattaatgcacagagaattaaaagatcttcaggtatatgattcaaattgtaatgaggggcaatgtactcaacatcaatattcctaatgaggcattatggtatcaactgtacctaggcaggagactacacttatgttgagcagttatagaattcaaaataactctgttaaaatttgataatccattctgttcacagatctggtcaccacctagcattcgctttgagagaagttcctttattctctccagttacatctgctcttatttcagtataagttgaacccagttgtcttacttccagaagtccaaagttacttcttttcttgggaaaaaaatttactgtgactcctggaaacagaagttctcactttatcatttttctgatctatttaatattataccttctcattttaagttccttttcccgctctccagaagtgagtgttccttagcgttctgttctcggtccccctcaagcccagtcttgctgttggtggtctacatctttgcttttgtcacagggaagtcactcctctagatgctatcttcagctttttcttgaaatatttccattctaccaaaactgttctcctaaagattaaaattacgtatttcccagaccaaaagacgcatgtgtgtttctttgcctgcttgatctctttgaagctcttgacaatactgaccatgccctaagtcctgagcattaatttttgctcagtttcatttacatcattttcaactagtttctcattttctctctattctttttgttttcaatgcagctcccagaaactaaatctatccatttaatattctttttcccaggaaaattcttctcattctatttaaagtgtaatattctagtttaatgggaaagttttttgttgttgttgtttagccttttaaaaatctctactgaaaaaattttggatatgaaaattagccaggcatggtggcgggagcctgtaatcccagctactcaggaggctgaggcaggagaatcgcttgaaacttggaggcggaggttgcagtgagctgagactgcaccactgtgctccagcctgggcaatggagagagactccatctcaaaaaaaaaaaaaaaaagaaaagaaaagaaaaaattgtgaaatgtggtctgagacaacttttctcagtgtcacctgaggcatgggttaaacaggtatattctaggacaggttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatcagaagttgagaatgagacaagtttgggaagacattgaggaatgtctcatattgtggtattgataaatctagagatggggccacagcttgcttatagctgcttagagtaaaatgattaatcagaaaaagtaatttccaaggatttgtagtcagtctgcctgaggctaatacatttattcacagcaaaatatctgctgcctaaaatgactctgcaagttacccctacaataccagctactcagagtgatgcaatcacctggttgcaataggaaattatcctggcttcagttatctagtagaacaggtgtacatatcaatcttagagctcttgagaagacccagtagccccagacccgtgcaattatattataagcactcaagtaacttctcagctaaaggaagaatgatgaagcaggaaagagagaaaaatgatttgtattttttgtggttaacttgcttagaaattttagggaggataaactcaatcttgactaataggaaatttaattaatttagagagttattaaataatagctcctccacatcagggactatgataaatgttattaacaacacaaagaagaataagactttcccttctaggaacataccatttagtgggaagaaagacagacagatacacacacacatacacacacacatgcacatacacttaaacagaagtggtagaggctgagggaaatcccataagatagacataaagaaagtgctccatttgctcagagttagaggtgaaaaccaagaatattggcagaaaagaatgttttaaagcaactttgaatgattcttccaatgatattggaattagaaaatgaaggtttaggcagagtggggagcaggacagtcactgaagtgggaaggcacacatgggctcagcaaaaccggagcacagtgtaatatcattaggggtgaagtcaagaaaagtagcttaaaattaagccatagagaatccaaagattttaaattttcttttgatttcaaaaatgatcttttcatattattgagccagaaaataattaagtcatctatatattagacaaagttgtcaaaagcaactaaatggagggatgttaaaatgggaaagaaaaaagctagcacatttaacctatagctaacaatactgtattatacacttaaaaatgtgttagcagggtaagtctcatagcacaaacaataaaataaatttcttaaagaaaaagttaactattggaatagcctagacaagaaattatgaggctttgaactgaaacaacaggaacagaatttgaaagaggagaataaacccttgggatacagaatgaacaaaattttaacactgtctgctgtaaaaagtgagggagatcagagggattaaggtgacccttggatttcaagaataaaaatatggccaacaaatccagggaacacagatgaaagagaatattcaataaagaagacatacaaattcaaatggggtcattctgaaattgtggcacatttgagatatcctcatatctatccttataatcaaaacaaactcactatctgctcattctatgaccagtgacctcactcactgctgccttatacttcagggcttacacgtagacacacacacacacaggcacacacacacacacacacacacacacacactaagaaaagtagcttaaaattagaccatagagaatctaaaattttaaaatttagaacagatcttcatctgagccaggaaccattcatctatggcttctgtcatttaatagaataaacaaaatctgcatatgaatccatgcagaactccaagttcagcatggtttctcactgttctcagagctggtacctgaagctgcaggtgtgcattctctgccacactctgtaatggatgagtggaaattcttccataaagcttttgtctattgggagcaggtaagtctaggcaaagtatgcacaatttttttttctgggatacccagtggaaaaaaatagaaaagcatcatttttaaagtactgaaagaaaaaaagtcaacctgaaacaacctcattctagccagggaaaattagtcatttcaagaaaataagagacaatcagactagaaaggaagatataaaacaatctctaactacagttgacacttgacataatcttgtatatagaaaatatgaattctcatacacatacacatgtacacagacaactccactagatttaataggcaagctcagcaaggtgcagaataaaagattgataccaaaagttctattgtatgtctgtatgttagcaatgatatgaaaatgaaattaagagcagaattatgtgtataattccaacaaaataataaaatatcttggcataaattaaacaacaacaaaaaaaaaaaacagaaaagacttgtgggctgaaaggtgcaaaatattgttgaaattaaagacctaatagaaagatactccatgttcatgggttggagggcttaacattgttaagtggcaacactccccaaattgatttatagattcatctctgtcaaaatttcaaaattctagttgtattttttttttggaaactgataaaccaaagtaaaaattcatatggaagtcccaagtaccaagatcagccaaaacaatgttgtaaaagtagaaaaaatgttgggcaactcacacttcacaatttcaaagcttattactaaactacattattcaaaacagtatggttctggaacaggataaacatataaatcaatggaatagaattgagaaccctcaaataaattcataaatttatgggcaattaattttagacaagagtgccagccaagaccattcaatggggaaagaatggtaaatggtaccaggaaaactgtgtatgtatgtgtaaaagagtgaagttgtatcttgtctcataccataaacaaaaaataactcaaaatgaattaaagacctaaatgtagaagctaaaactcttggaagaaggcataggtatacatctttgtgaccttggtgtgtatgtaaccagcagcaaatccatatgggtctgcagtaaactcaattctagctcctaggaggagagaatttggccaaggggcagaaagaagtttaaggcagaggaaaagacccgggcaagttttagagtagtagtaaaaggaagcaaagtatacttggaagagggccaagcgggtgacctgagagacctaagggccctgtttagcccttgacttagggttttacacatcaccatggttctagggtttgtgtttctcctcccttgatgttttcaccttggggcaagctgtctgtgtgctcagtggcctgccagcacttgggaggggctgctcatgtagtgttcttactggagttgcgcacatgctcacttgaggcatttttcccttaccagtggggtgttcctagagtcatatgttagttaaactccgtcatttagcctctgtgcacatgcttgagcccactcgcccaactccagagatcttatcgggaagctgctgattacaagctccagatgtttttttatctatgtggaaactgtctttcccggatgctggttgtgactaattatcatctttgagagacagtttaacaaccacctgaccatcacctgatgatcacctgacattctggagtgtgtgtggtgggggtcggggggaggggggagagggggtctcttctcgtgccctcttcatatctgcctacctattctaacaggtatacatgaagcagattcgctgtgcactgttactaattccaggggattgtgttaattttccagggagaaatgcatgaaggatagtggaggtcatcaccatgccaaccaccacttcacagcccactgcatcttgaactgcaatttccatcacttgcctgattcatataacaagttgagcaaagcaaatttattactcacagacaggcagcaaaggacagtagaagcttaggattcatggtgagtttgtctctcaaggctcagaaaaactacacaggatggatagaatcttgcctgcatatgcctcatgttgcattgcagctgagtggctctgaaagtgcactctgtcctgggttttaaacccaggggctacatttaatgggttaaagcactgtgggacatcctgttccaggagagacaagaacagaggccaggattttcctgccagttcctcattatcacaggatgtggtattgctagcacatcctacagttattcttaagaactataaaagagaaaagggagatccacattgccaaggccatccagggacttatccttcagagtaggcagtgacttcttaaatatgaaactcaaaacacaggcaaccaaagaaaaagataaatttgacttaataacattttttaaagtctgtgcttcaaaggacactttcaagaaagacaaccccaaaatggatatatacttgcaaatcatatatctcacagggaattgtatcaaggatatataaagaactcttacaactcaataatataaagacaaataacctaatttaaaaatgagaaaggatctaaacatgtctccagagaagatctgcaaatggccaaaaaatacatgaaagatgctcagcatcattagtcgttagtgaaatgcaaatcaaaatcacaatgagataccacttcacacccagtaggctgtaataaagatacccagacaatagcaggtgtaggcatagatgtgaggaaattgggaccctcaagaattgctggtgccattgtgtaaaacagtccagcagttactcaaaagttaaacatagaatgaccatgtaacccagccatccctctcctaggtatacccctcagacaataaaaaatatgttcacgtaaaaaatttatacacacacttcaaacagtattattcatattactcaaaaagtggaaatatccatcaattgatgagtggattaactaaataggttttatttctaaaataaaactggtgataaaaaggaacaaagcactgatacatgctataccatggatgaacattgaaaagctatataaagtgaagaaggcaggcacaaaggggcacatattgttggacttcatttatataaaatgtctagaatagaccgggtgcagtgactcacgcctgtaatcccagcactttgggtggctgaggcaggcggatcatgaggtcaagagatcgagaccatcctggccaacatggtgaaaccccgtctatactaaaaatacaaaaattagcttgtagtggtgcgcgctcgtagtcccagctactcaggaggctgaggcagaagaatcacttgaacccgggaggcagaggttgcagtgagccgagatcgcaccactgcactccagcctggcaatagagcaagactcagtctccaacaacaaaaacagagtctaaaataggcaaattcttaaagacggaaaatagattaatgattgccatgggctgtgggaaggaataaaagtgaaatgacatctaatgataaagaatttctttctggggtgatagaaatattctggaattcatggtgacagttacagctttgtgaatatactaaaaaccacttaattatatatttgaaagggtggatgttatggtatgcaaattatatttcaattttaaagaaaatgtcaacactcaacatgaaaatattcaaaattacagctccaacatcagaataaagactatatttttggatctctaggattctgatatgagtaagaccatgagtcattattatttggacactaaatgttaacatgatcttatttattattcaagtcatacacctaactcctctggggtgcctatccaatggagtgagattgtgccttgtttcctgtatctttctttcactactcctgggacaaagtagactttcacataatttttattcaatgctgcaggatgagaaaggacagaaaaatgggaggaagaggctgggcgtggtggctcacgcctataatcccagcacttcaggaggccgaggtgggcagatcatgaggtcaggagatcgagatcatcctggctaacacgatgaaacccagtctctactaaaaacacaaaaaattagccaggcgtggtggtgggcgcctgtagtcccagctactcgggaggctgaggtaggagaatggcgtgaacccaggaggtggagcttgcagtgagccgagatcacgccactgcactccagcctgggtgacagagtgagactctgtctcaaataaataaataaaaaataaaaagggaggaaggaagatctctcaaacacaggcatcccatgcatgactacagagaatgatacagataggtatgcagaataacgggacctgaggtcagagggggaagtctttttagagtttgttctttgaatcacttatattgaaaattcaagtggaataagtgaaggtgacaaaagtgaattacaaatcttaaagttccctgaaaatgcttgaagccatcccttagctgaggtgtgggagtgaaaaagcaaactgagacaatgtgaaatcattttctatctcgaattttccctccagcaatgttggtgtccacttccctgtctcttaatgggtgcatctatatatcacctcttgtcaatacctctactcagcaacagccagaaaatagaaagattatataagccaataaaaggaaaataaaggaacaaaaaataagaatagtggagagatcatctacttgggaggctgaggtggggaggattgcttgagcccaggaatttgggaccagcctgggcaaacagcaagaccccatttatgaaaaaaatgaataacattatctgggtatggtggcttgtagtcctagctacttaggaggctgagatgaaggactcacttgactgatcctaggagattgaggctgtaatgagatatgattgcactgctgcactccagcctgggcagcggagctagatccagtcttgaaaaaaaaagaaaaaaaaggtgaagagggaaaaaaaagaacgagtaatagaggtgcttacttcacaacactaacctcacaaacacacactaagctaggttgtgtgtataggtcagaacaaaagatctaccatttaactgacatataagattggttctcgaaaccataggacccactggaaatggtgacctcacaggaagatgcatcttgtaggaggcagctgtgaggtctggttccccgacgtgctgcagcaagtgcctttgccctgcctgtgggctccctccatggccaactctgctatggacaccagagtactctgctgtgcggtcatctgtcttctgggggcaggtgagttttcagctaaaggatcaccatcactgggctttgttttgggctctacagcagattctcaaatataccctggacctctgtgttgaccaaatattttgtgaaaggtattgacatttatatgaaaacaaataattgcattatggagtaaaaagcaaaattcatgtgagtttttaaatgaacgcaggagacttcaaacaggctccttcactgtaagacattcatccttctgccattacaactctgtctcatgcagtctcttctcctctgaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacccacattgatgcagagccacatcctctcagtccacaaacatcctccagacctgccttggaaacagcggtgggccaggaagggaaacgcgttacctgtacagtgaacaggtcagctctacggtattctgcaagttgagggtggaaataggggaggattgtaggaatagcatgaaacatcccaggctacgctcagaaactaagactctgtcatccaaagaacataaagatttttaagaactagacataatttttcagtttcaacattgacttaatttgtcagtttcaaaacacttagcagtgtaactctgttttttactccacactgtatgtcaagttctatatttcatgctttacatcaataattttatttaatcaccaagacacacaagcaaaggaagtgctttcttccttttcaccaagagaaattatggtcctaggagttaatttttagaaagaaagagacagagagatgggggaagaaaggggaggggaggggacaggaggagaagggaagggaggggaagggaggggaggggaggggaggggagggaagggagaaggaaacctagtaggtggcaaaaagcatttggctcaaagggttatgatttttatctcacatcatgctgcttagcattcttttaggcataatccttgttctgttccttgctgagtacccgtgcaggtttttacggatgctaggttcaagaattcctgctataaaattatagaacatctgagagatgatggaaatagagttggataaatttgtctagaatttagggaaaaggtctggcccacagatattgttcattagaaatgtgtcacctcaactttttgtcttaatgtttgtttttattctcatcactcaacagatataggccacctacagaaaaagatttgttataatttgctttgatgaaacaatttcataaaatcaaaaggcagacaaaagcaaagtcatttcaaatatatgtgcagactaagtccagcctcaccagcttggagtataaaccatgtgattccactgcagtttttgccctttgattttctaaaatcatttaatgtactcctgcccctccctcactttacccaaaaggagaaaaacccagaaaatcttccaggaagacagaagagggacaccggcttgggagcctgagaaagatccagagagatttccagaaaaagaccaaccctgagaccccagcaaggctgcagagaagatggattccaaacttcatgccatttaaagcaccagacatgtaatttaaagaaacagtcttccaaaggtagtgctttacagggaggggaaaaaaaggcaaagaggaagaaagagggtcttctggcaattcaatagtgaggagaaaaagaggaaaaaggggaaaactgagaattctgcaaaacaaaaggaaatcacaaatcaagaggacccacaaccagccccactacgaaaacaaacaaagctcactaaggagtctggattttgctagaatgatggccaaaggaacattagactaggaattttgtaaaacacctcaataacacgaaaatgagcaagatgaaagtaatacccgtacaacaaaggaaaacatctcacctctgttccctgttccctcatctcaaaagcaatcatgagtcagaagataatgtaagtctacactccaaacagaaataaatacactcaaggaagcagctgaggatataagtgaccataaccagaccaggactttaaaaactcagactacaaatggccaaaatgggaagacatcagaaaaaaacacaaattgattgaacccaggagggacatgaaagaaaaagacaaagttatcccagtcatgcaaaataaaagatgaccaagggagaataaacccaaatgaaaatttagtcaggacattgaacaaaggcaaagaaacaagtagcagaatgagaaggacatgagtgaaaccagccagttagaaggcggtcaaagaaggcgaggtcttggtatgattgcatgaggggcctggaacagcagcactgggctctgtgcagcaggacggctaagcagcaggttgtcacagtggccacagcactactggccagaccccaggagtcacagtttccctgagagagctgagggcataaacaatgataagttctccaggggatggacttcttaaatactctgagttcatcattacacattctatgcatgtagcaaaataccacaggcacccacaaataggtacacatattatgtatcaatgtttttttaaaaaaaggaaaaataaatgaattccacattcttgtataatcagagtatctacagcgctcctggagtaacccaaaccttatggttgctggaaagataaaaaaccaatgggccaattggggtgaaactctggcccggaaacgtggggtgccagccccctcagcacagatgcaatgcagagttatgggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaagtgagtcctgggttcagggagaaaattcctatctggagtgctgcaagttccaaatctaaggcctccccgagggacagcagcatcaggcgcctccctgggctgtactcaggcatgcctctctttcttttccagacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccagtcctgcttccccgaccaggtgacagggctcctctgcactctatgatggcaggaaacgccactcagccactaagcaggtttaaaaaactgtatataactaaaactctatatataaactatgcatataaaactaaactatatatgtatacatttatatataactaaaactttatatgagactaaaatgatagttttatatagttttttaaagtatagttttatatatatataactatatatatatatcattttttaaactatagttttgtagttttatttatttatttactttttggagatggagtctcactctgttgcccaggctgcagtgcagtggcatgatctcagctcactgcaatctctgcctcctgggttcaagcaattttcctgcctcagcctcccaagtagctgggattacaggtgcataccaccacacctggctaatttttgtattttagtagaggcagggtttcaccatgttggccaggatggtctcgaactcctgacctcaggtgatccacccacctcggcctcccaaagtgctgggattacaggcatgagtcaccgtgcctggctgttttatagtttcatatagttatttttaaaaactatataaaagtttttgtatagccacttagtggctgagtgaagtttcctgtcatatatgatatagatatagatatgtttatatatgatatagatacagatatgttatatatatgttatatgttgtatataagatatatacatatagagagagtcagagagacacagagaagaaggaaaagttaatcttacaacccccagcttttttctattttaccgaatgctagatgaatagatggatgaatgaatagaaatgaatgaatgaatagaaaattttcccttctttcaggaagataaaaaagcctgtggaaagagagatgtagaagacaaaccctgtaatcacaatttcatatgacgcgtgctttaatgagagacgttagtggagtataggaagtaacacagccaattctgtctggtgacatcaggaagggcgtcaaacagaaagcaaattttgagatgaaagttattattcaaatttcaccagatgggcaagtaggatttcaccagatgggcaagcaccaaaagagggaggcaggctaagggaactatgaaaggaaagagtgatgagataataccaggaaaaaaattatcaacactccctcctccaccggaatatggcaatggaggaaaatttggacaaatgaatggagtcaagttattgaacaaaactgagtttcttgttctagtggtccttcattggatatctgtgtagaaacatccaagaggctccgtaagtgcaggtctggcacttagaagagagggttgggcttgagagaaatgtttgagtgatagttaagcacacaggtgtgagtaaaacttcccaggtgatcttgtcttctatgctttctctctttatgctctgccacctatgccttgaattagaaggtaagtggtgtaagtggtgttatttcttatgttgacttacacatgtctatttgatcatataattacatttctggaaattgatgtttctatgttattcttcaaatacaactaaaactgctggttgaaaatttttgtaaaatattgtcagaagcatcaaataaccttagtctgtcctgctgtattgtcctttttttccagggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcctacacatcagtcattctctgagccagaggatggagccaaggaccttcatggcggtgggaaagacacagtcccatagtgctatctgtgccctgtatacaagccattttccagaggtgatgggattgggaaagactgtctgtccaatgagaggaagaaaacgaaagggaagacagtaagagatagacaatcttgtttttccttgtttttcttgtccgtgactagaatggacacaaattcctttgtttcagttgaggaatttattaaagcagggcataagagcttaaatagacttcaaaaattctactgtaaaactattaaccatttgcttttttcagggtaatcttaatactgaaaagaacactgtagctatgaagtttcatcataatctccattcccacaaccaggttgtaagagagatatcatctgaagtgaaggacaggaaatttttaaaatgtaaaatatcactgaatgttttcttagcaagttttgagaggccatcgcatctattaaataggaagataatttatataaaattttaatctagaactgtatttctttaacataataaacataattgctctatttaaaatcacattgaacataacaaattgtaaattagacaagtcagaaaaccaatttgtcaactgtttaaaaattgaagaaatagtccagaattcttaggaagcagaaagggatatttaacgtgtgagaaaaaggtactaccacaatagcagctttattcccaatggctccaaattggaaaatattcaacatctgacaatgcaatggagaaatgattgtgttacatttatgtaacagaatacaatatagcacaaaaaatcaagtgtaatttccaacacagatatttcaaatataacattgaataaaatatagtagacacaaaataatacagtatgtagtcagaatagtgattaaatttggtagcattatgtatttattctgagggagacatgaggaaggcttttggaattctaaattctatatcttgatctgggtgatgattacatgagtatattcatttcaaaaattcattgggctgaacacttaagatttgtgcagtctatgtattttatacctcacttagaaaacttaaaatggcaagtatattatcttgaccaataatctattgctgtgtgacaaaccactccaaaagttagtgatttaaaagaacaacatattattatctcttgtgattctgtagaagggctcagctggacagttctcacttagggctgctcacatggtcactgtcagatagtcactgaggctgaagatatctgaagactcaactaggctgaatatccaaggtggcttttttgtgcccctgttggttcgttacctgggatggctgcagtagctgtggacccgctgagcatttctctctgtacacagccttttgatgtgattagatgagctgtctcacagcatggtggcctctaggcagctaaagttttggcatggtcgttgaccaccctaactgtgagcattcaagagacccgggtgtggtcaactaggctccttacagcccagcctgagaaatatgcagtgacacctccaccacaatccagccagctcggattcaagagaagggcacccctgggaaggtgaccactggccagtgtgtttcatcaggctggtgtctttgaagaccaaataccacaccacagccatttgaatttgtgtcattacttggtactcttattttttccctgctgctctttttgcattgaagtccttttgggatgacatcaataaaactatttcatgtttttaagattgtatttgtcaagtatttctttttcaacctttctacatgcagcctttttgttgtttttattcttcaggtgggtatttcataagcagtgtgtattttttcagcccatgatttatagaactagaatcctcagtctattgtcttaaatgtatttctgtatagttttctatagaaggtgatttcctgggttttgagttatgtttcttgcttggttttgtacattaatttttctcacattttggtttcttcttccctcatgcatgaccttatttttgttgactatttttctcatttcattattttgcctttcagaagtccgcaattcattttcattttttgatggttaactgtaacattttattatataattatattaagaaaatctgagattagtcttatctttaccattctcctgaagcctatgtgaactttagaacaattaacacctatggttccccttcatgatttccaatattttggatagtcagaatgttagatctaccataactagaagtattgttttattttaccaatacttaattacaattacctacctatgtgttaaccatcatctttaatcgtcattgtttttgcacaaaactttagtataccaactcagagcagaaagaggatccatcatattctgtgtctgccctattaagcatgcttctctgctgcatggcctttgattcctagtagtagatttatcccaggcaaagatgtagagccctattatgggctatcagatctcaacaccaaggatttcttgtgccacagccctttggtgccaggcctctgactctaacttctatctctttttccaacagttctcatggatactgaagtcccccagacaccaagaaaactggtcacattgactaattttaagagatggccttgaagtagtctcagaaaatgaaaagtcatagcacatactagctattgacaatgtatggttttggctatggcaaacccataacacaaatggaagtgtcagggaagaaaaaccaccatgagcattaaggaacaaaagaatatattataggaatgaggcctgacacaatttggggagaagatggataagtgaaagtttgaaaagggtcagaaaaaacaactctaaccagctctggtgaaggtggatgaactggacttcgcattaagttttgcattaagctgttatatccatacactatatggaaccctgaaggggctggtgtaggaatctatgaagatggctgactctatgtgccaatagccctgtgagttctcagaaaatttggtggtggcactgcagtccctcctggtcagcagggctggcagtcggtataaagagctggatgtgaagcaggggaaagtcagcataaattggaactcaccggcacttttgatgctactccttactgcctggagccagtgatgacttcagaactcagtagcagctgttttactttccccttacaaacttcctgcatttcttaccccatgatcaactctaacccggaaccatactaggaaaaaagttgtccgaaacatattccttgcttagctaagttgacacagtgataaaaccccacaagaatatccagatgctccttgacttgcagtggggtaatatcctgataaatccagcacaaattgaaaacatcataattcaacttacaatatccagcttatctgtacataaccccatcataagtcaaggagcacactgaaatgcatattgcttttgcaccattgtaaagttgaaaagtcattgaaccatcatgagaccatctgtacctgacaattagtgtttctcaaaataaataggaagattttcttctgatctgaaggtcttccagccactccctcccagacatatcataatattggaccagaggtcacccatagcaagctgtccctacttattctttgcagaaaaagtacagttacagtatgaagtggcctcattttaatgaggcccaacatacccaggaaataaaaaatgcagccacaggagcatacagatgccctttaatagatatgtcaatattaacataatgcaatagctatatttgttataaaacgatttcactattgcacaaacataatatgatgggcgaagtcttaatcttatcttttctagctacctatgccagagaagcagaactaaatattaaatgaaaggcacaattgagaggctgttataaaaatgaaaacatagggctttcaaaaaaactttccagctccttgtaattgctacatatttccaacatcgatccattaaaacaagtatcccagcctgttcaaatcaaagaatttcttatgcctcctagaaactattttcactgtccagtacttagtatgacctccattacaatagaataaatttaattattctcacaacctcaacagtgattaacacggaaacatacaagctaaattgagaaatattattagaatgtttagaattaagtccctttatatatgagggaaattgtcatgagatacacatgaggtaactatctcatttagaaaatgatgaagtggcttcaacatgattatgaagaaacattggacttccagccgaggcactggcctgtgctttatcaatatttatggtagtgccaacctgtgggtctagtgattaacaaccatgagttgtcttggtgttattactttgaggatatgaaacagaagcagcaaacagactccaatgccattcattacctaaacctacactcctttccttataggaaactcacttaagtcattacaatgctttatgtctcagtgtatctttaataaatttggaagttgaattgggaagtctttaggccactttaggcaatgtatgggttttttgttttcttttgatatggggtctcactctgtcacccaggctggagtgcagtggcatgatttcagctcattgcaacctctgcctcctgggttcaagcaattctctccctcagcctcctgagtagctgggattacaggtgtccaccaccacgcctggctaatttttgtgtttttagtagagatgggttttcaccatgttggccagattggtcttgaactcctaaccttgtgatccacccgcctcggactcccaaagttctggaattacaggcgtgagccacctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgccctccgccccagcgggccccctgagtgctgagaggggaagcgtggagaatggaaaaccacagctttcctgactgagacatctgggagtgtgtgtgcagggggtggggcgggggggagggggagaaaaagaaaagaagcactgtgagtgtggagtatggaggaggtgtagtgtttgagacccacgaaatggcaatagagttgggcctaaagtggtcggcggacatggaaagttccctgaaaattataaaacctggaattttgccctgactctgccacattagtcatgtattcttgaatagatctacacataatcctagaggtagatatgaagacagttgtataatcactgtgtatttcctataataaacttcagcgattggctttcttgtcatcatgctgggctctcaagacaaagataaccaagaggcagccaagtagagagttatgcatgaatacgttaccttaggggaggatagcaacagcattgaatagcattcactccaaatttgtgttctgtcctccttagaccaggccaccaaaataaaatcctatcacatttcctgtaaatgttgaacgccatcatgttctccatggtgtttcggttgatgaatgaacagagtaagactcggtacaaagggaggggagcaccctctatgcctaggtacacaccatacggaatgtatcgctagggaaggtgctggtgagctggctcctgggaaaggtgtcaaggggaagagggggcagaggtacctagaaggaagacctcagacaacatggcttgtctacagagttggaaagttctgccagtagttagaagacagtaagtggaacagtgaaaatcctttcctaggagaaaccaaacatttacattgaccacaaatctgtatgaaccaacagaaaatgagcaaaacatatgaccatacatttaatagaataaacatatatgactaataaacatatagagatatttcacttcattgatgatcaggataatatgaagcaagacacaatgatacatagttttatatccacttgattagcaaaatataaaaagtttagaaatataaaatgttagcgagggtatggattcataggattacttataaattactgatgggagcataagtactatcaaccatttggaaacagttcagcattatctcgtagttgaagattcctatatcccataactcagcaattccactcctaggtttacatcaggagaagctcttgcatacacatatcagaagacataaataaaaaagtgttcttcacagcaccaaacagtagaaaaacatggcaccaagccacatatgcactgagaagagtgaatgaataaactgtgacatattcatatgagtcaaaatgaatgaactacagtgaagagcaaggttataggtgaatcttagcaatataatagcaaatgtaaaaactaagtctaatgagattatgcaaagcataatgtgcttttcataaagctaaaaacaagtcaagaaaataattttcaggactgaaatatattagaacaaattatattgaaaggaaagcaaagatgagttgtatgctggagcctactttatcagctcatgggagctgactgtatacatttttcccaactccagttttagtgacatcattttgttagcttgaaattggccatagtgagggtatttacactacagaaattagcaaacacagcaaattacggtttgctttattttcctccagacttagctgtcaaccctttaccctttaccaacacactactggcagggaataataatgacccaagttcaggatttttataaggctggggcatggcaggaaatagaatgagagagaactatatggctatacattgaaatattgtcaaggtctatcttgcataatgttgaggaggagaagttttacaagttcctattatgttttttaaaaatattcattgacaagcaatgcctgtgtgttatgaaccacaggttaagataaataaaattgaatgcatatagcatcaaaaagaagagaaaacaaataaatgaatagattagagttcttacaagaaaaggatcaagggcattttatagtcaaaaccaggagtgaaatagcagtggcttaactgctaccatcctcatatagatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcgtctccgctatgaccgtgtgttgctggtggttaaataccccacctgggttcagtcacctcagactgtgccattgccactgatctcaggacccactttagttgtagccttttactctgttagcgttttcagcctggagaacagagctagtaaaatacttataaaatattccactgcttcactaacggcatggaaaagacaagagcttttaaggctctggcatgaaacagggagacagtggttacattcctatttcacgcagtcactatttccgtctacgttaagctgaggagtgtagtgtttcggtgacatttagcatggaacgctgctgggttcagacctgacattcccaaaccagctgactgtcaaggacacagcctactgcctacctatattaccttaggaaacgagacaacagcattgaacagcattcagtccatatttgtgttctgtcttccttggacaagtaccaacaaaataaaatcctatcacatttcctgtaaattttgaatgacataaatttttgatgagcaattctttttgaagtgttgaactttctgttctgattttatattctactctctgtgctttgttgtatttaaaatcaagttcacctttcagaggcagtgatgggtgaggtaagagacagactcttacatcctcctccccaacacacacacacacacatacacacacacacacacacacacacacggaggcactgtttttcccagtaatggagaagccatgggaagaatttcagaggtttcaagggagctagggtcgtctaattcctctatatccttggatatccccattcttaatgtcaaaaataatctctcgaactggtttcccagagtctcaacccatttgctatagtacatgcaccatctcaggtgtccaaagatgaatatttgataagctacttctcaacttcatacctctgctgctgtttttccattctggaatgtggaaagcagtgtgactcctattaactgaccagtagtcaattttaactacccataaatatgtgagtgtcttttatctgtaatctcctatctggtgccatttttgaaaaccagttaagactcttttatcctaaaaaatgaactatgtctaatttcttgaaagtaattattgatgaaatactccctggagagtctgaagcccctgatattgcatatttaattgttatcctccttttaataaaaggtataggaagaaattttaaatattattcctaaataccttacatcaagatgagctagagttaattaagtgggacgagggataatgaattcaagggcatttaagaaagattaaagaaccagtgcaaaatgttttaatcaggaaagaaattagtgtgtttaatgacaggaaagaagtcagcagagtgacaggagcagggggaggaggtggttgagtacagggcaaaattgaagaaggcaggaaggcaccagaccactcagaaccttactggtcaaggtaaatgatacagaatccaacataaagcttaataggagacactgaggttttcaacatttgacttctttagtaatcagattcgtggctgtgtgtgtatctgtgtatttaatcaccctggtcacaaagtgaagaaataatggaccatgcagggaaggcaaaatgttacctctaccctcttgcagtttttcggctggtcctgagaatggaagattaacaggaaggaaagcatacacatgtatttaatacaagttttacatcacatgaaagcccccataattaaaggaagaactgaatgtgcagttagagttgaacattcatatattgaattgggcaaagggtcatacattgtggaaaggtgaaaaagtaaaggggcttaggctagggttgctggttgaatggcaaagtgactaggaaggtgaggattagtttaacaagctttttttgttacagattccttggcctcaacatcatcccattctatcttggatgttaagaatattcttttttcctggtatagataagacatcttttatatgggaagcttattccatttttcaagaagaaaaggggaagggtcagagtactcctcttatacttgctattgtgtttaatgcctctagctcaaaatattccttatgccaaagtggcatattttgggcagagggttgggaggcttatgctgccaccctccagcagtgtgaacagagttgatgcggaggaaaaacttagctcaggcaagcagtagtttagctcagataatgatgatggtgttagaaatatggggaaaatgagacatttaaaaggaagtaaatcaaaggacttggcaattgattagacatgagcagcaatatgcagggggtggtgggtggtgattaagagagactgctacacacagacaaataagaaggaccaagtgggaagaagatcaagatttactttgagattgggagtgccttagggacagtaatctaaccaggaatatgcagagagcagttggatgtacaagtcatggactcagaaaatggatctggataagaagcacacctttgggacatttagcatcactggaagaatgaaagtgcctccaatcccttgatatacagtttacaatgaaaagatcagagagcataggatagcggtttagggagcacacctgccttgggggactataaaaggttgagggaggcaaaatgcactgataaaccaccatcggcattagactaatggctgaataattgtgtaagtaattgctagtaacaatgctgtggagtatgtggcaggtagcacatcaagtgctgcttttttcttaatttcgctctgatacctggaatgcctttttgctgcctcgctgccgggcgggccactcccgactcaggcaggccgaggcagagctccgcgggcattggatgaattcgctcctttgaccactagagggtgatgtggatctttctataaaatatctgccgctcatcaagtggggactcacagcttcaccggatatttcagatgagatgtttaggtactgactgaccaaaaaaattgcagatatcctgggaggccaattggtctttaaaatggcaggatctaatcttaacattttgtaataacccttagcgtttacccatatctggcacctgtagttgtgtgatttctacacagttgataaatatataaatgaataataccgtgatttctattcaacattgtgctgaatttgcaaccagtgaaacaaggggaaaaagttgaaaatgagaaaggaaagaaaaataagtattggcgcacgacaagtttatttatagagattcaaaagggtctaaagaagcaatgcattatcaataacaaaatgtagtaagtttactgaatttaacataaatataaaacattattttattttcacatactacaagcagttatgttttttaacgagagacaatttacaaataatgatataaaatagaaaataaacacctaagaacaaatctattagattagcaagactatcatgcagaaaactattaaaattttaggggaatcagggccgcgctcagtggctcacgcttgtaatctcagcactttgggaggccgaggcgggcagatcatgaggtcaggagttcaagaccagcctggccaatagggtgaaacccatctctactaaacgtacaaaaaaattagccaggcatggtggtgcacgcctgtagtcccagctagtccggaagctgaggcaggagaatggcttgaacccagaaggcggagcttgcagtgaaccgagatcatgccactgcactccagcctgggcgacagagctagcctctgtctctaaataaatacatttaagggaattattttaaaagtttgaaataagccaggcgcggtggctcacacctgtaatcccagcactttgggaggccgaggtggctggatcacctgaggtcaggagttcaagaccagcctggccaacatggtgaaaccctgtctctgctaaaaacacaaaaaattagctggacatggtggtgggtgcctgtaatcccagctactcggaagcctaaggcaggagaattgctggaacccgggaggcggaggttgcagtgagctgagattgcaccattgcactccaggcggctgggcgacagaaagaaactccgtctcaaaaaaaaaaagtttgaaataagtaaagatatacaacatgatcatgaaaaagtgaatccaatagtaaggttgtttcaatttctgcagtattatctatatattcaataccacagtaatcaaactacaaaagatttactttatgaaatttgtcaaataatctacaactaagtgaaaaagaacaaaaataagcaatatttaagaagtacaaaaagtgatgtgaattgctctaccaattatcaaattatgttatcatttaggataatgaaagaagcgtgattaaataggcaaatggaaaacagaaaatgaaaaataggcccatgaatatacaggaatttcatatataatagaggtgttattgaagatatacggaggaatgatgtaatatacaagttattctggaacaggtggttatccatacaaggaaagatgaatttaaaccttacttcacaatatatgtcaaaataaatcacaagtgaattaaatgcttaaatgcaaaattcaaaatgttaggagttttggtaaataataaggattatatcttcatgaacttgggctatggaagattttttttaacaaagaattaaaaaacatgtttaccccaaataaaagaataatgcattctactaaagaaacccaacaaaaagtagcacaaacagaataaagacatacaccacaaattggaaagatattagcaacacacatagctgacaaaggttgggtatccagagtctagaaaaaactgttacaaataaataatagctaatcaaccaaaaagaaatatggacaaagggcagtttacaggcaacactggtggcctataatatatcaaatatattcaacctccttagcaaccagaaagaagcaaacaaaaactatattgcaccatgagataatattaacatactagactggcaaaattaaacgtatattaaatagcaagtgtagtcctagatgtggaacatctgaacacactcatgagctgttggtgggatcacttatttggcttaatcactttggaaagcattttgttatgttatgtaaagttgacatgttgacttgaaaactcagtctttacattgccaggtatggcaacaatcttgcacctagaaaagcagagacatgttcgagaatacaatactgtttgtagcagcacaaacacccagggaaaaattagtgtgcattaattcaagaatgaataaattctagccaatgaatataatgtaatactagatggcagtgaaagtaaattgtctagattgtgtgtcaacgtattatcacagacctaatgttgaatgaaaaaataacattgtagaaaatatataaactagctgattcctcttagatacatttcaaagacacacaaaattaaatactacataatttacagattcttgtgtaaatgctaaagactataatgccaagctagtgaatgacaaatttaaacttcagattacacctacctgggcatgacggagaaacaatgaggaaatctaaaagagtaacatggactgagaaattttcagcaataatctaactcttaagctgattggttcaggcaaaggtattcattttattgcttctatatatgcattgcatatttgtcataaatattgttctgtatagttcaacatttcattatttaatgtagccgggcacagtggctcatgcctgtaatcccaacagtttgggaggctgaggtgggcagatcacttgaggtcaggaattaaagaccagccagtgacatggtgaaagcctgtctctactaaaaatacaaaaattagccaggtgcggtggtgggggcctgtaatcccagctactcaggaggctgaggcaggagactgcttgaacccgggagacaaaggctgcagtgggctgagatcatgccactgcactccagcctgggagacagagcaagatccgtctcaaaaataaataaataaataaataaataaataaataaatacttacttaatgtaaagcagctgctatgtgattttataagtgtgtcaaaagctactatttgtaaagaccgagttgtatgattccttacctgagatggaagggaggggaagaagcaaactgacaagttaaaaaagtaaatagagtgtaaattagttcaaccattgtggaagacagtgtggagatttctcaaggatctagaaccagaaataccatttgacccagcaatcccattactgggtatatacccaaaggattataaatcattctactataaagagacatgcacatacatgtttattgcaccactgttcacaatagcaaagacttggaaccaaccaaaatgcccatcaatgatagactggataaagaaaatgtgacacatatattccgtggaatattatgcagccataaaaaaggatgagttcatgtcctttgcagggacatagatgaagttggaaaccatcattctcagcaatctatcacaagaacagaaaaccaaacaccgcatgttctccctcataagtgggagctgaacaatgagaacacatggacacagggaggggaacatcacacatggggcctgtcgggggatggagggctaggggagggatagcattaggagaaatacctaatgtagatgatgggttgataggtgcagcaaaccaccatggcatgtgtatacttatgtaacaaaagtgcacattctgcacatgtaccccagaacttaaagtataataattttttaagtaaataaatgtatgagtgattttacttaaaaaaaatagcaaaacagtgagtaacagaaaaaaaaaaaactaaaagcaggctgaaacttacactatttttaacagctaaaacaaagtctgccctcctacattctttgaaattgaaatgactctgtcccatgtacagagcatctacaaaggctatggaaagtgatcacgtcacaaggaggttgctgacgggggctaggagagtgggtgaagaagccttacagaaaaagctaccactacgatttctttctgagccaaccatgtgcctcagacttctctgctgtgtggccatttctttctggggagccaggtaaggccctgttctgaactggttgaatttcagttccaagactctctccggtggctgcagtatcaagctccctcctgcgctttttctacagctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagtgccgaatgttagcccttcttagaacacaaactcattatggacccagctcaggaaataagtgtgtagcaggttggtaggcactacgtaacagaaacccaacttgaaagacaataaatcagaaggaaaaacttgtaaataacagctctaagtgagcaaaaaacaaaggggggttatttaaaacaactgatggggacaaaaccccagggaaggggccagaaggcataaaaagcttggattcctcagtgttcagcatattaggtaagatatgctaggttaccctctctctctctctacatgagctttatggatttctaacaatctttatttaaagaaggggattctgtgcttttcacttggtaaagttgtgggtgcacaaataagaatgacaagcggatcaactgtgtctttcaggtagaccctgatcttctgacccagcacatttccttgaactagagacagactctaaagggctttttgactgcttctcacagctctccctgccatagaagcctagtgggaaccattagcaattcctgccctatggaatgttacaatcacaaatttttatttttatttatttatttatatttattttaatttttttttgagacggagtctcgctctgtcatccaggctggagtgcagtggcgtgatctcggctcactacaagttccgcctcctgggttcacgccattctcctgcctcagcctcccgagtagctgggactacaggcgcccgcaccacgcccagctaattttttgtatttcttttagtggagacggtgtttcaccgtgttagccaggatggtctcgatctcctgacctcgtaatccgcctgcctcggcctcccagagtgctgggattacaggcatgagccaccacgcctggccaacaattacgaacatttttaaagcaactctattgagacataagatatatatggaatatgtatgcaataaacaaatccaactgctgcaataaaacacacccgcattttaagtgtacacttcaacaaattttaacacatttttatacccatgatgtaaccatgatgacaatcaagatacaaaacattttcatcgtctcagaaagtccctcacatctctttattgaggtcttgttaatttctctcagcatcgctttgtattttttattatacagatcttatatatattttcctaaattttattttaacaagattataaatgtactcaataaaaatattttctgccaagatttcacgtcagcctaattcaatttcgtctttacatttttcaattgacatctctacctcagtatgttacataaaaataccttctccagaaattgcatatggtttggagcaaccatatgtgagctcacagcgtcagcctcattcaccatgtgaaccaatcaagtgttagtgctgctctgtttccaggtaaaatatacttatttacatgtattggaaaagctgtgaaatttctgcaaggtgtactttaagaagagatacattttgttaatgaaaacatacctatgcgttaagattaattaaagggaatattttgcagttaagcacatgatttggaatgaggggttgcagccctgctggtcaagcctctgaattccattcttgtttctcccataggccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgaggatcttaaatacagtagaactgtctaaattccatcaataagaatagtgcatatattaccaatattgggatctgaggtgtctcagaattagtaacacatagtactgtagagattattttaaaacatagtgtggagataattttgtgattccattttaggaatactatttctgattacatggtttcttagcataaagccttactccttcatgcaagagagtatatactatcatactatgtccctgtagttttctattccaataatgctcctcaggaataaaatatacatgataatcatgatgatgatatggataatgatgaatataattgataatgcagacagtatgtagaaagatagatgatagaatttgtaccatgtttccaggactagaacacaatcatggtaagtataatataatacctgttataattgaagtctgtaaacagtctaaagaagtagtttaaattgtttcccttgacaccttgacaaatctgcaaactacacatataggctaagtacttccgaggctatatgaacgttctaaaaaacatttcctgtctgtggattccagcataatgcatattctcttctaaggcagaagtttttaacctgggatccgtggacctccaaggagtgcagagataaaattcagggaatcaataaatttgaatgggaaaatagatctttattttaactaacctccaactgaaatatacctttccttctatgatataatgagtaaaccatagtagttttagtaatatcagtgacaaagtcaatgacagaaatcacagacatttgcttatatgttgcatagatgacagttgatataaaagtcagatattttcataccatgttaaatgcagtaaatatactttcatcactatgttgaaatcatgacagttttcagattcagcaggttatatttcatataatgaaatttaaaggtgttcctatattaatatatgagaatttaaaaaaattgatatctgcatttcaaaataattttctatattctagtttatgcatttaaaatgttattctgagatggggtccttaggatttaccagtctgacaaagaggtccctggtacaatgtgaagaactcctggacacagaattagatcctcaacgcaggcatgattgacaacctgaagcctagacctacgcattggaaacaactatgttgcaagcattctttctcagagtttcacccacactgccgcacctcttaatgcttctcactctaaataattactttatattctctttctgtctctctcctgctctttgttttctctctctctctctctctctgccttgtttttcttctaggagggaacagcaacagcttctaaaccccaccagcttgcaaccaaaagtttcatcatgaaagcatcttttaattgcagataacctcagaaatagaacaacatttgtctaccaaaacaaaagcattcattaagaaatcagctaggatcctatttttatttactaaaactacttggaagaacccatgttatacaatgaatttacactcatacaaatttctactcagttggaaaatgagactttagtcagctggtacaaccctatgaccataaatgtctcatttcacttgatacagtattgacttcctaacttcctgtgaattagaacttcaggtccagaaagtaataagagcaaacgcaaatctagtgtttcttatgtactaagaactgttctaaatgctttatttatgtaatgttcatcacaggttttgggtagttacttattatctcaattttacagataaagtgaaattgaagagatgctctgtaacttttccaaggttacatagctgcgaaatggcagagacaggactaaagcccatgccgtgtcccaagtccctgctctaatccattgtcacaagggaaggggcgcttcagacactttgctattcctaaaattgcaggagtagcccccaccccatctctactgtattaattatttatagtgaatacagagggtgtagagaatcggttctttaaaaaacaaaaacaaaaacaaaaccactaaacttccaaaccccttcttgtgttgagttgagcacaggtgcatggcactctgtgtatgactctgaccaggaagtgagggattggctcttctgaccatgcaggcaggcacttgtccatttagaagggatataaaaagcttctataagcagaagaggaggtgcatgtgacttgatcgctctaattcttagtctcaccatctgcaaaatcagctgtgaaaatcagtcatcacgtagcaatgacaaattctttatattaagccccggggaggggctagatctcagccccttcccttggcctctctctctctcttagagcctgtgtctgtaacttcagagagattttgtcgctgccatggggagctgggtcctctgctatgtgaccctgtgtctcctgggagcaggtgagctcagcacacatccaggtggtcaattcctattctgggcttgccaggcccttccctggccagcacctcccttccaggcatgatctccagcctttgtctcttggacccttggatgctgacatctatcagatgccattccagctcactggggctggatgggatgtgactctggagtggaaacggaatttgagacacaatgacatgtactgctactggtactggcaggacccaaagcaaaatctgagactgatctattactcaagggttgaaaaggatattcagagaggagatctaactgaaggctacgtgtctgccaagaggagaaggggctatttcttctcagggtgaagttggcccacaccagccaaacagctttgtacttctgtcctgggagcgcaccacaatggaagcacaaccattgtctctctgtgcggaaatgtgtcctcaccctacagcccccaccacatcctctagcttaattttttcatttttaatattttcttgagattttactatgtcctgttacttttgcaaacacaaaagatacaaaactgaaaagaaaatagatcctttatccaaggagctaagagtctagcaataaagtagttataacagaatggaaaatataatgtataatactaaaatcagaagtcatttgggagctttagggaggacatgcccaattctgtctgattgaatcagagaaaacaaagaggaagtcacattagaacttcaccagctagacctggttctgagtagggcattctgggcaaagagaacagcttttgcaaaggcatattaaagagtttgtcactttggggaacagtttacaaagagaaagaagatgatcaatttatatgaatcaaaagaaatggaatacatttgaggaagtagacagaaaggagtttttgaaaaagttgagtttttggttccatgaatacaataagtatgaaagtcctttgtaggctgttgctcaaaagagagagctgaagcttcattgtcatcagcagacaagcaaacaatacaatttttcaatatatatatatattttcctcatgtaactttgaaatgatactatttttccattttcctcatataactttgatccttaacaaagggcacagtttcaaacaatatgaaatcatgttagcagtagcagttcccatttgggataatagggttcaactgtctatggaacaatgagataaaaactagaagcaggcaactgcatagacaagatgtgaaattgagatgccataaggctggactagaggttgagattctgcagatttcagcatgtaaataattgaactatggggacagaaaattccaaccaaatatagatttagatcacagagataaaaggcatggaagttaagactgtggtattctggttccttatggagattaaagaagcctaagagtgaggagtgattagaacatgggatgtaaaaacaaaagagggaaagagagagagtgagagttttgttttgtctagtatttgatatttctaagaaaattcgggaaaaaaataaaggtaacccaggcagaagaagccgcaaacacttcttgggtaacagggaatagttggtaaaatgtcatatgttagtttactgaggtgcacagaaccttttccactgaggttccttttggaaagacacaagacttagctaagattccaagaaatcaccaaagtaggaaatgaaaagcctccatgaatgaagttgcatgagtctcctaccagtggataaaggataggataggataaaagaatagctgcaaaggataaaagaatagctgaggcactgaagtagaagctccaagtgagaggactaaatctaacaaacatgaagaattattataaaaccacaacaataaaagtggtgtaatataagggcattgatatataaataggtccaaggaaaaaaatacatgttcataaacacagagcaatggtactgcaacaatcaaagaatataattttcaataaatggtgataggaaaattgggtatctatataaagaaaaataagtgcaattggacacatctcaatatatagccaaaatcaatcccagctatattaaaagcataattgtaataaaatcacaaggcttctagaatactgtataagagcacatcttcatggccttaaagcagggaaagagttcttattccctcaatcatagggaacagattgataaaaatggctatatcaaaattaacatattgaatttatcaatgttaattatgtaacagtgacaagattgactgtatagtgacatatcattaaatatctatatatttataccaaattaatatccctatttatatttatattttcaagaaaagctagtatataaattttttaaaaacctacaaactaatttttctacagatcaatgagaaaaaggtaactgtcaatggaaaaagtgagtgaaaaccataagcacctagcaaaatctcactggtcattaaacatgtaaatgtggctatatttaataatcagggaaatagaaattgagtccaacgaaatatatacccacaagaatggctacgatgataaaaatagtaactatcaagtgttggcaaggcaaagtgtcaacaagaactctctgaatcactggctagagtgtatatcggtagatccagtttggaaaacaatttggtattatctagtaaagttcaagatgtgtgtacccactatccatcaattccacccttgagaaaggcttttctagagaaacccttctacgaaaatcaggacaagaatattcactgtaatacatctgtcatggcaaaaacgtataaaatatccaaatgtaacttaagagaagaataaatcctggttattaaaaagaaattacacagcagtgaaaattcatgaactaaaactaaacacacaaacatgaatgaatttcacaaatttgaatgaaaaattacattgcagaagaaaggtacagtattgtctcgtttgtgtaaagtttgaaagcatctaaaactaaacactattttgtttgcttatgtgcctatgcattaaaatataaaagagaagcaaataattacaaaaacaaacacctcaatagagttagagaacagaggcatggaatctgggaaaagaaataagagctttcaaatattctggtaatcttttatttcctgtgccaagttgtttttttaagtgatcattctgttggtattttatcaagttattatctatatattcaaagtccattttgtaatgtggagaaaacaacctcactgaacaattaaattagtaaggagaaatctatggaaagatatacattaagctgttaacattacttacctgaaatgaggatgagatggaggaagagaaaagtaagcgaaaaaaaaaatcatcaaaaaatgcacaatttaaaataaatagttacagagagaaaaagcaaaaaagggaggttatgtaaaagaagcactagtaaatgaacaagctaaaatacaccagaaagagctagaaggtgaagtatttttcaaagcagtcactagtttcagaatcataaagatagcaattacaacagagatctgaaatatataaaagataattagataactaatagccagaaggaatgtccagtcttgagttagaaactgatgctcaaattaatggcaaaggacgtttttgaaacaactgtgaaactttgcataaaaactaaatagtagataagatgaaaatgcatcgatgagaaaggatgatcattaactgaaaaaaagcttatcaaacagaatttcaagaatattgtttactaaaaaaagtgtctatatatctacacatttatatatggggcagagaaggatctagaaagactcactaaggtgttaacagtgataattgctttctggcagtggtatcatatttttattttgttattttattttctaactttctaaaatatgagtgtattgcttatattagcaaaaatagacataacatatttttaaatgaatacaaaataactgagttatatttcctgagttaggataaaagctttttttccctgatactatgaagtgtttttgctcaggaacatgaagcaataacatgatgattataagtcagtggagggatcacgtcacaagaaggtgcagaaaggggatgaaaaagcctcatccctttgcaacgtcaatgcgatcatgggcaccaggctcctcggctgtgcagccctgtgtctcctggcagcagatgcgccctgagcacaaaagaaaaatccttgtcctgggcttgccaaccagcagatccaagctttgttttgttttgttttgttttgttttgttttgtttgttaagctctttcctggactctttctacagcatctgtttctttctcttacagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatccacagcactgaaatgtcagttcctcttagcacacaaacttgtcacagacccagctcaggaagcaggtgatgtattaggctggaagggagtaacagaaaataactggagccagcttaagccacagtgtaatttaacacaaggataaagggtgtttagcagaagtcaagaggtgatagaagttctgaaaaggcaccactagggctgggctctagaatggctatctctccagcgctgatttttattcaattttggctgctgaatgcttttctctccctgtacaccatctctttttctccaggcctcgtggtgagaatgagatggtcactaaagattacaaattcagttgccatcatttccctacactgataaataccaggctggctctttctaagcctcaattcaaaatcccaagagaaaaaaacagatcagtcatgatccagccattaaccttctcacagagcactcagcaggaggcatgtatgtatatatttaaaatcacataaatattacttttccactcagctcaagcaagggaagtgctccgtttttctgtatgtacatttggtcttgttgcttctacatgatagagagtactcatacccatttcttcagaaatacatagccagattttctccagttttctgccagaattgaaaattcttgtacaaataccttcatagacttgtatgattgctttataggattatatacccagagcaagtcatgattgctgagacatggaattctatgcatattttatctatctaaataccaccacgggttcttcaggatcactgtatacatctgcaatcccacataaaagtgaatagggtgttttcctacatcctaatatctcctttaatccttatccagtgatctagattgttctcagtctagcaatgtaaagagattccaatctctgtctctctttctctccaccccccacccctgcaaccctctcacctactgccagaatatcatcagtgtttaccataaagatacaggtgacaattttttaaaactaaataaaaccaataatttaaaggaactgagagattacgttatactactataataataactggcagcaatctagaaggctgaataatgttctctccctccttttctttcctttgcaattttctaattactaatgagtttgagcacttcttcatgtgatagtggtcctggatttctgttctcaaaatggcctatccatatccgctggcaaattctctattgacagttctatattttcctcaatgatttgtagggggtcctgagatatacaagatattagtctcctttctgaaactttaggcactggaaataccaccacccaatatggcaccacctctgtcccagacttcaaagaatcagtagatgtgggaggaaccaggtgatctcttaccttagcaggtgcatgcgtgttatctccattatgtgaatgagacttctatctttcacttccactctgctgagtgctcaacttgctgtctcttccattattactcatgtctttaagcagcatagaaaagttaccagccatggctgtccccaaactactatcacccactgacaaccctttccatccagaactgctgaaaaaatgcttcactccatttagctgtgcttttttacaatatggggcaaatttgattcaaattaattcttattgctcttttctaagtgaattatgctgcctggttatagcaaaggacagaaaaacttcacacatctttttggaagacttaatacttgcccacacattatctcttttagggccaaattccatccactgcaaacacctatctccttgagctcttgatatgacagctgatccattttgatttcacaaatgcttacagagcaactcccattcactgagacataaaggcattcagaaactttcagctacactacatggaattttggtctctggggaaagggagaagagtaaaaagaaccataaaaatgtatttcaaataatgtgtataaggatgacaaaatatagattactttcatgaaaaacattagaacattatattgtctttgggagtgatttatcagtggataaattaaaacaaattcctgaggaagtttgggaaaaaaataaatttaggaaaacaaattttaaatgatttcctgaaaaccatcagggtttaccataaagttaacaattgaaaaaaatcaaataatttaatagtgaatgagaatatgaatacagaaaattcatatgaatatggaatgaaatattagtaaaaatgtgtttgagaacacttacaaatgaattttgttgtccaatttgattaagagtctagtcaaagtgttactcttttaaactacttgtaatagtgtcagtttgacaatctggaacaaaaacctttaaaatgcttatttttgggaatttggctctaaatcaaaatagatagttgttactgtacttgttctattgccttaagccactataaaacttgacaaaaattgtaagacaactatgttcagacatcagacaacaggcagtacacgtcgccatctctgggaaagaggaaacctagaaggggaatttcgctattgtcctaagactctgccttggtatgacttctgggctgcaccacaagtatatgaagcccaagcagtgggcagtggtctacccagcatagggaggcagagattgagttcagaagtatggacatggctgatagtgatagggataagctactgcagagaaggaagctatgcagaataagacctccaaatattttatgaggtccccttaagtctttggtcaaaaactaagcagcaaatgcatgggaaacgcctccataagacctggcagagaacagttgctgggtagttgtgagaggaatagagattctgacagtcatacgagcgtgggagacatgaatcctgactgggcagagctgagaggccttgctgaaacccctgggaatgcagctggcaccacataagggtcacatctcaagagaaggactaccaacgtcctagagtaaaccactccagaactgccctaacaaagctcagcaagtctcaaaaggatctcgctgatcttccaataagttcactgccttttgaagaaaaatatctcagcactctctaaataaaggcaaatataaacatatacatatatataatctgtagatatataagtctgtagagagatatgtatctctagagtgtcaacaatgcagcatctacaattttgatcttgacatgaaaaaaaatattagacatgggaagaactaggaaatgttacacatgggaaaaaaataaacaataaaaaccaaccctgaaataatacaaatgttggaaatttcagatgagaattttcaagcagttattatagaaatatgttcaagaatttggaggaaaatatggtcatgatttaatcaactgatgaaattgattaacccatagcaatcaagacaaaaaggggaaagacacaaattaccatatcaatgatgaaggaaagcatatgtctatagatacaaaagacattaaaatagcgacagaatattataagtatatgcaatacattcttcaacttagatgaaatgaaatttcttgaataataccacttaccaaaatgattcaaaatgaaataagaaatgtaaagaacttcaaatgaaggaagttaaattttttatcaaaagccttccctcaaaggaaactccagacctgaattatttcttcatgaattctattctaaaattaaggaaaaaagactatccatcttacataaattttttaagaaaatagaagaggcagaaacacttcacaacacttttataaacccagcaaaaacctaatgccaaaatctgtcaaatgcattacagaacagtatcttttatggctgcaaatgaaagaaaacttttcacaatatattaacaaattaaatccaaatatgtctcaataaaatactggcaaactggatccaggagcacatcaaaaagcttatccaccacgatcaagttggcttcactcccgggatgcaagggtggttcgacatatgcaaatcaataaacgtaattcatcacattaacagatctaaagacagaaaccacgtgattatctcaatagatgcagagaaggccttcaataaaattcaacatcatgttaaaatctcaataaactaggtattgaggaacatacctcaaaataataagagctatttatgacaaacccacagccaatatcatactgaatgggcaaaagctagaagcgttccccttgaaaacgagcacaagacaaggatgccctctctcatcactcctattcaacatagtattgggagttctggccagagcaatcatgcaagagaatgaaatacaaagtattcaaataggaagggagaaagtcagattgtctttgtttgcagatgacataatcctatatctagaaaaccccattgtctcagctcaaaagcttcttaagctgataagcagcttcagcaaaatctcaggatacaaaatcaaagtacagaagtcacaagcatttcaatacatcaacaacaggcaagcagagaacaaaatcatgaatgaactcccattcacaattgctacagagataataaaatacctaggaacatagctaacaagggaagtgaaggacttcttcaagaataattacaaaccactgctcaaggaaaccagagaagacacaaacaaatggaaaaagatttaatcctcatggataggaagactcaatatcatgaaaactgccatattgtacatagtaatttatagagtcaatgctattcccattaaactaccattgacattcttcacagaattaggaaaaactattttaaaattcatatggaaccaaaaaagagcccaaacagctaagacaatcataagcaaaaagaacaaagctggaggcgtcatgctaccggacttcaaactataaggctacaataaccaaaacagcatagtactggtacaaaaacagacatatagaccaatggaacagagtagagaactcagaaatggatcacacatctacaccatctgatcttcgacaaacctgacaaaaacaagcaatggggaaaggattccctatttaataaaaggtgtggggagaactggttaaccatttgcagataattgaaactagacctcttcctcacaccttatactaaaactaaatcaagatagattaaagattacatggaaaacccaaaactataaaaaccctagaataaaatctaggctatatcattcagatataggcacatagatttcatgatgaaatcatcaaaagcaattacaacaaaagcaaaaattgacaaatgggatctaaagagcttctgtacagcaaaagaaattatcatcatagtgaacaggaaacctacagagtgggagaaaattctgtagtctatccatctgacaaagatctaatacccagaatctacaagaaattcaaacaaatttacaagaaaaaaacaaacaatcctattaaaaagtgggcaaaggacatgaacagacacttctcaaaagaagacattcatgaggccaacaaacataccaaaaaaaaaatctcaacaccactgatcattagagaaatgcaaatcaaaaccacaatgagataccatctcataccagtcagaacagccattatgaaaatgctggcaaggttgtggagaaataggaatgcttttccactgttggttagaacataaattagtttaaccattgtggaagatagtgtggtgcttcctcaaagatctagaaccggaaataccatttgacccagaaatcccattactgggtatatatccagagaaatataaatcattctattacaaagatacatgcatgcatatgttcattgcagtactattcgtaatagcaaagacatggaatcaacccaaatccccatcaacgatagactggataaagaaaatggtacatgtacaccatggaatactatgcagccataaaaatgaatgagatcatgtcctttgcagggacatggatgaagctggaagctgttatcctcaacaaactaacccaggaacagaaaaacaaatgttgcatgttctcacttataagtgggagctaaacaatgagaacacatgaacacagggagaggaacaacacacactggggtctgttggggggtggagtggggggagggagagcattaggaaaaataggtaatgcatgctggacttaatatctaggtgatgggttgataggtgtagcaaagcaccatggcaaacatttacctatgtaacaaacctgcccatcctgcacatgtaccccagaaataaaaaaaaaagaaagtagagttgctataaagtacatctactgggggggaggtaaaaccagataattcactcaaattttgatgaacaaaagcttccaaaaattaattttcttcaaaaaatagaacatttacttttggatcaaaaataaataaataaatccaaatatgtatggatatatgtatatatttgtgtgcatatacatatgtgtatatgtggacaattctacaacatgtccaagggagtttattgcaggagaaacagtggtttagcattccaaaatcaatatacttttgctgtacagaagctctttagatcccatttgtcaatttttgcttctctcaactaatgtgatcaccaagaatagttcatattcagctcccaaatattaattccactcaaattactgcccacagcagggggcaccaaaacagcatgtttactttaagaattgcaaataagggcaatgatttttttttttttacgttgaagacaaagccaaaataaaagtttttatgatcattgtcttgtttatattcatcagatgcctggctaaggaatttactggaacaaatccgtattttcattcatattactaatggagaactctaaccaaaaagagaagaagggaggggacactggaatatgtcatctggagtgtaggcaaaggctgtaaaatgtgcttgggtactcctaaataaagcaacaactattcaaaattacacaggagaggcagaagtggtgaaggaggaggtagatgaacaagagaggccatgaggagttggtaattaccaaagatgactcatgtgaggacatgaaggctcattgtttattaagcctactttgtatatgtttgaaatttttagaattaaaagtaaaaatatctaaaaataagactttaccaatttgacatgcagcaggaatgattagggtaggatgccatggtgtatccatgcatgagggagggtcagtgatatggacaggagacggaaatactgggtagaagagggtggtttcccagcaaaggccccaccctcaagcctggagacctgcagctgtaaatggggacaagcattcctgttttcattcccaaaaagttgtcttttgacccaccatgccccctttcttttacccatataaaccccaaaccccaggcttcagaggcagagaagcaggctaggagacaagcagagggagggcagaacaacgtggcagagaaaaagaggaggaacgtctgaaacccgagaggagttcagctggaggtggtcagagaagagttcagtccctggatggccaaactccaaggggaagatcatcttctcactccatccccccttccagctccccatccatcccactgagagccactgccaccactcaataaaaccccacattcatccttcaagcccatgtgtgacccaattcttccaggacgctgggcaagagctcgggacacagaaagctgtcacactggccctctgcccttgcaaaaaggcagagggtccactgagctggttaacactcaagccgtgtgcagatggcagaactatctgcccacttgggctcctgcatctgtccctctgtgtgttccctttcccctcaggggtttgagcagttgcagcaactgaaaaggtgagcaacactcctgtcgcacgtccttccaggggggtcagggaactcttcctttttcaccaggacgagcacagatctgaagcagcaaagagccagttgtttattacattgaacaatgtttcacactatcaccataactgttctgtacttgcaatctgctgcattaaatattagctctttcctcctaaagtcaggaataatttgtgttagaataaaatgaattctttaatgaacaactgtattttcagctaattcaaaataggaatgaaggcgttaagtacttctttgaagcacatacccacattaaactaacatctttctacaataagccaatatttttaataaagctctgtgcccagaaaacattgaccagaaaagcaggagccactaaaaaataggagcaatttgaaacaaagttaggaatcctgtccttcttacaacaaaaaagtctcaaactttacagagaatgtattcaaattgcatagtttaccaagaactgagttagaataaatgattaaatgcagaaaaaaaggagaagagttataatgtcctatcattcaagtgagactagacttcctttattcgaaattcaatttggttttgaattttctccagcctgttttatcaggaggatgatgtcaccttgaacaactgaaatggatatgccctgagaaaggggagagatacaactctctggtggttgccagtaaagcgccagaaaaacagaagagaagcaagtagaagaatttcagcatctgctaagaacatataatacataagccaacatggcatctttctttaagacccagtaccttgggagggacaatgacatcacttcctgaatcctcccagttttctatttccatgccctgcttccctcaacatccagagctggaaacacctccatcctgcctcttcatgccatggcctccctgctcttcttctgtggggccttttatctcctgggaacaggtgagtttggaacacagatggggaaatcactgccttaaattttccaggttctgaattaagcctatcctcagagattgcagcacgaggatatttaccagtttctgtcttcaatttctgtcttatttcccacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttgcacagtgcttcttggccacctgctctctacacagaaagacagacacatgggtgagttgtttgctctgaagggtacctggatgtgggttgtgggatgtggggtgtttagagctttcagtggtcttaggtagtgtgagctaagggccactttggatcaatgtccccaagccatgtgatgactctgaaagcacaggctacactgaatcaatctcccctgtctatttatttttcctagggagctagacgaatggtgacctttcaggagaaggaacttgagcatttgacagaagctcatgattttcaacaagagcatttcttatgagctgaatacaatgcagtttttatagtccttttgccattatttccacccactttgcaacatcccacactttgttctgttcccactgacagctcctttatcctgtctaacctttctctgccccagttcttccaagctcagctccaccatttagctctataattgattgcctttctactaaaaacaaaataactagcttgttttctaaaacttcactgtaagtaaatttaattgtcattaaatctgactcagaagttaaagttcaagtaacagagactgtgatttacaaaagtaatttttcatctactaccccacactttgatctctgctgagattcattttaacctgcaggtgcagatagacttgcattattatctggatgtactgaatttcaaaaaataaaattccctgtccccagtatgaggtcaaagctaggagcttggaagtgccccttgtttccaggcactagaataattccctggttcccctgctgtggggattcttttaggagccagtgaggcccaggcacaaaaataattgatcaaggactgccagagcttgacgtaaaagtcttcctgagaatcaagttgatgtcttcctcatggatttagtcttcttgtcccataagcctcaattatttcagcaaacgaatccatgggacttggtgactgttcagaaatgaagaatccaacttgttcccttttctacctgttctcatgtgtaaagcgtgttacttttagggattctttctcattggcttccatttaaaaaacaggtttctccagagttttgtttcctgctttctatgcacacctcatcaagtcttatcagcaataataattcttcccttacaagctgttaactgtcccagttaattgtctcctggacatttctgatagatttccccaggatttttccttctgccctcctttttcctcagtacacatgtctttcctcaaccttcgcattcattgtcatgacaacttctttcataggttcctgcctggcaaattcaactatctactggacacttgaagctggatgctccataggcaattcaaactcagtttatccctgaaataaactgcctctccatccttgcacttgcccattttggccacacactgtatttctatctcagtgattggaacagcccttctaggttcctcatttttgctatgcctcatattaaatcagtttctaaatctattacttgtatatcacacattgtcatagtttgtgttctccaaaagcagattttgagaggaaaattagtgtgcgggaaggtttgtggaaactgcccttgcagtccacgtgggcagagggaaatggggcagagggagaagttgggctttgctgtatcctcaacaaagtccttcactcaccccacagggagctctgagtctggatggtcctttagtgccatcccaaggtgagatggcaggtcttattcccactttccttgtaaccatgtcattatatgtgagttgctctgagaagcactcatgaatttgatggggaggaagtgtctctttagaacaagaccattcacagagagatgtcggcatcacagtttctaatatacacatatttatctgattcagttacccctctccctcctcattgcttctacctcagtgcagaccctcatcactcattgcctagaaataaatgcaatgccctctccctggcttactagcttcttacccctttcccttaccctatttctcacattgccaccagcatgaccacatatgacattcctcacacaacacacaaagccctttggaaatggttctccaactaaacatctggccaaattggccgaattcactccagcactttagactgtagctgaactgaactttttatatttccctgaatataccagcctgaattgcacaggtgtacctttgccaaagctctttccttcatctgaaatgagcttctttattccttttttgtcaaaactaattttttaattgcaaattttattacagattagtgggcacatgttgtgcaggtttgtcacatgggtaaattgcgtgatgctgagacttcaggtcccaacaatcccatcacccaggacataagcatagaatccaacaggtgattgttcagcccatgccctgctccctccttctcccatctagtgagccccagtgtctatggtttctatctttacaatcatgtgtattcatttagctcccacttaaaagaacatatagtatttgattttctgttcttgcattaattgcttaagataatgtcctccagctccatccatgttgcataaagggaatgattttgttcttttatggctgcatggtattccatggtgtatatgtaccacattttctttatccagttcactgttttgtttttttttttttttttttttttttgagacggagtctcgctctgttgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgccgggccccagttcactgttaatgggtgcttaggttgattcaatgtccttgctattgtgtatagtgcagcaatgaacataatgggtacatgtgtccttatgacagaataaattatttccctttgggtatatatccagtagtgggattgctgggtcaaatggtagctccattttaagttctttgagaaatctccaaactgctttacacagtggctgaactggtttgcattcccactaacagtgtataagtgttccctttcttctgcagcctcaccaacatctattgtttgaaataaatcttgagtgcctggctaatcctcacatatcctttaattctcagatcaaagatgagcttatctataacagtttttccaatgtctgtagacaaagattcagcttttctcttgtgtgtgatagtttatgcatttcaaagttatcatagttgttatgtcccttcatacttctttaacttttattttgggttcatggggacatgtacaggtttgttataataaacagttatatgcaaaactgtgatgctgatctctttctttttatggctgcatagtattccgtgatgtatatgtactatattttcttcatccagcttactgttggcggccttttaggttgattccatgtgtctgctattgtgaatagtgctgcaatgaacatctgtgtgcatgtgtctttatgatagaatgatttctactcttttgggtatatgcacaataatgggactgctgggtcaaatggaagttctgttttcagttctttgaggaatcaccatactgctttccatgatggctgaactaatttacactctcaccagcagcatataagcaatcccttttctcagcagccttgtaaggatctgttattttttgacttctgataataaccattctgcctggtgtgagatggtatctcattgtagttttgatttgcatttctctgatgattagtgatgttgagcattttttcatatgtgtgttgatcacatgtataccttttgctgaaaagtgtctgttcatgccctttgcccactttttaatggggttatctgttttctgcttgtaagtttaagttccttatagaatctggatattagacctttgatgcatatatagtctgcaaatattttctcccattctgtagtttgtctatttactctgttgatagtttcatttgctgtgcagaagctctttaattaggtctcatttgtcaatttttgatttttttgaaattgcttttggtatcttcatcatgaaatctttgccaagtcatatgattaggatggtataatatttcctaggttatcttccaggggctttatagctttaggtttatatttaagtctttaatccatcttgggttgatttttgtatatggtataaggaagggatctagttcaatcttttgcatatggctagccagttatccccagcaccatgtgttgaataaggagttctttccccgttgcttgttctagtcagctttgtcaaagaccagatggctgtaggtatgtggcattatttcctggctctctattctatcccattggtctatatctgtttttgtacagtacaccatgctgttttagttactgtacccttgcagtgtaggttaaagttggtaacatgatgcctctagcccttgttcttttgacttaggattgccttggctatttgggctttttggttccacatgaattttaaaatactgttttttctaattctgtgaaaaacgtcattagtagtttgataggaatattaggttggtgcaaatgtatttgcagtttttgcattgttggaatttgccatttggtattgaaatacattcttaagtaaatgtggttatgttatacatcgttttaatgaacattttcactttatgttttttgctaattacttattacttgctacttatttggtatttattttagactatacacatggtgttagacaaaaagcagatttgagtgattttcttattcaagttcaaactgagtcataaagtggcagagataacccgcaacatcagcaacgcatctggcccaggaactgctaatgaacatacatacagtgcagtgttggttccagaagtttttcaaaggagacgagagccctgaagatgcagagtatagtggcaggtgatcagaagttgacaatcaccagttgagagcaatcatcaaaaccgatcctcttacaactaggcgagaagttgttaaagaactcgaggttgaccactctacagttgttcagcatttgaaacaaattggaaaggtgaaaaactcgataagtgggtgcctcataaagtgagcaaaactttttttaaattgtcattttaaagtgtcatctcttattctatgcaataacaacgaaccatttcttgatcagattgtgacatagaatgaaaagtggattttatatgacaactgccaacaatcatctcaatggttggcccgagaagctccaaagcacttcccaaagccaaacttgcaccaaaaaagtcatagttgtgggcgggaagcctcccaggtgccgaggcaagagaccgaggacacgagctgctccagtataataaaatataaaataagaatagttataccagatatagatcttagatatgattatatatgaatatcattaatcattagtttgtagcaattactctttattccaatattataataatcctcgctctataatcataacctaggaaaaaccagggtatacagagttaggagctgaggagacatagcgagaagcaaccagaaaagagtgcgagccttctgttatgcccggacaggtccatcagagggctccttggtctagcggtagtgttagcgtcaaggaaaaacacccgctacttagcggaccgggaaagggagtctccctttccctgggggagtttagagaagactgtactcctccacctcttgtggaaggcctgacatcattcaggcccgcccgcggttatccggaggcctaaccgtctccctgtgatgctgtgcttcagtggtcacgctcctagtccaccttcatgctccatcttgtacacctggctctgccgtttacttagcagtagcaaattagtgaaagtactaaaagtctctgataagcagaataatagtgtaagctgtttctctttctcctctctctctctgcctcggctgccaggcaggaaagggccccctgtccagtggacacatgacccatgtggccttacctatcattggagaaggctcacatgccctatcctgcccctttgtcttgtatccaataaatatcagcgcagcctggcattcggggccactactggtctctgtgtcttggtggtagtggttccccgggcccagctgtcttttcttttatctctttgtcttgtgtctttatttctatgctctctcatctctgcacacgaggagaaaacccaccaaccctgtgggtctggaccctacacgtggtcactgtctggtggtctgctgccagtgtgatccaccacagctttctgaatcctggcaaaaccattacatctgagaagtatcttcagcaaattgatgagatgcaccaaaaactgcaatgcctgcacctggcattggtcaacagaaagggcccaattcttgtccacaacaacatctgaccgcaggttgcacaaccaatgcttcaaaagttgaataaattgggctacaaacttttgcctcatctgccatattcacctgacctctcaccaacaaactaccacttcttcaagcatcttgtcaactttttgcagggaaaatgcttccacagccagcaagatgcagaaaatgctttccaagaattcactgaattccaaagcatagatttttatgctacaagaataaacaaacttatttctcattggcaaaaaatgtgttgattgtaatggttcctattttgattaataaagatgtgcttgagcctagttatgatttaaaattcaccaaaactacaattacttttgcgccaacttaataccatcgaatctacattgctttggccagtaaggccattttaatgatattgattcttcctatccatgtgcatagaatgtttttctatttgtttttgtcatctctgatttctttgagcagtgttttgtaattcctgttgtagagacctttcacttctctggttagctgtattcctaggtatttgttgtgtgtggcaattatgaatggaatcatattcctgatttggctcttagcttgtatgtttttagtgtattggaatgccactttttaatgttgattttgtattttaaaactgctgaagttgtttatcagatcaagcagcttttgggcagagactatggggttttctagatatagaatcatgtcatctgcaaatagggatagtttgactttctctcttcctatttggatgtctatttcttccttctgcctgattgccctgaccaggactcccagtactatgttgaataggagtggcgaaagagggtatctttgtcttgtgctggttttctttttatactggctcttcacaaggctatatatattctttagttaaaagtagacatctcgatggaccagtgactatcaccctattaatcagtcatgggagcactgctgtgcatttggtattttaactttcgggtatgctatcacatcacagaaggcctggtcccctccccatcacctgcagccggacctgtctttgattcctaccaatcacctatattaattgtgcctaaattcaatattccgacagggcataactaccctaaggtgctaattaattcatgcttgaaggacataacagtaattaacagacaaacacatacaaccgctccccttattggacttttaaaatgaaaatctgcaacacccccctgccccatctctgacttcatcaacccaggaaaaaagacaccttgccaaacttcaaaaacaagtaagccttaattcaactctgccagagcccaaaatatttgtattttagctttgggtatccccaacagctacccctcaactaatgcaaatttttttaggaaactaacccctcaccaatctaattctacttttacaacaattatatctaacacgcacgcccatccattactaagcccatatcctaaatttacacaccccgaaaggcatcatctgtcaccttgtactacaccaaccactcgcgagtactaaaatctactccaccaactcctgctaactcaactttaaatccctgaaccctacaactgtgcatattgcctgtatcttcttctatactccaattttgcacttaacatatatacagttaatgtagcttaattatttaaagcaagacactgaaaatgtctagatgggcttatacagccccataaacagacagtcttggtcctggcctttctattaactcttagtaagattacacatgcaagcatccccatcccagtgaaagtacatctaaatcaccttgatcaaaaggagtaagtatcaggcacgcacaaatgcagctcaaaacacgttgctcagccaaacttccacgggaaacaacagtgatagacctttagcaataaacaaaagtttaactaaactatactaatatccagggttggttaatttcatgccagccaccgcagccatacaattaacctgagctaatagaactcagcataaagagtgttttaggtctatccttaataaagctaagcttcatctcagttgtataaaacccgggctgaaataaaataaactatgaaggaggctttaatacttctgaagacacaatagctaagacccaaactgggattagataccccactaggcttagccctaaactccaatagttaaatcaacaaaactattccccagaacactacaagcaatagcttaaaactcaaaggacttggcagtgctttatatccctctagaggagcctgttctataatggataaaccccaatttacctcaccacttcttgctcagcctatataccatcatcttcagcaaaccctagtaaaagtcacaaagtaagcacaagtatctacataaaaacattaggtcaaggtgtagcccatgaggcggtaagaaatgggctacattttctacacccagaaaatctcacaacccttatgaaatctaagggctcaaggaggattcagcagtatattaagagcagagtgcttaattggatgaggccataaagcacacacacaatgcccatcaccctcctcaagtatcactttagagattagtttaactaaaatccctacatatttatatagaggagacaagtcgtaacatggtaagtgtactggaaagtgcacttggatgaaccaaggtgtagcttaacacaaagcatctgtcttacacccagatttcaccataatttgaccaccttgtgccaactctagccctaaacttaactaatagtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtctggtacatgtgtatttaagtcctccacacctcccatctataagtctttttaaaacaaagaaaatatgtttggttaagagaaggctggaaatgagagagggagttttactggacaaaaaatgtatagagacttatgtaacaattattatctgatattaatatctgatggtaatacataattgattgagaactagggtgaagtgacataatcccaaacatacatgggagaacgttcggggaaatcaaagctgtttttcttaatggaatctgagttctgagaaagaagacatgcaaaggaggatgcaaatatatgaaaatatatgaaatatttgttgttttaattgttaacacaaatttatatactcatatatttgagtctaattagaatatttaataagttaagtttatgcctggagtcctagttttagtattacaggcaaagaagcagagttagaaggaaggaggggaatgaattatgcatgctgtatttgagggcctttggaacttccgaatgctggtagagtacacagttggcactctgtatcaatggggtcctcatttgcagatttagtcaacctcagatgaaaaatatattttaaaaattacaaaataacaacacaacaaaaaaaatacaaaatctaaaacactgaggtataccaactatttgcatgacatttacattgtattagctattataagtaatctagagttgatttaaagtatacaggaggatgtgcctaggttatatgcaaatactgtgccattttatataagagatttaagcatcagtggatttaaactaatcccccatgaataccgagggaccactgggttgagaacatggtgctgaagctcataaaaagcccttgctgtgggattctgacataagacactgcataaaagctcaacacacatgccctatagtcagtgtctgtgattctctggaatcaaactctattctgtgaaaacaggaaccgtgatggtacaggctattcttggcaatgggaaatgaaacctcagaggtaatcctacttccatgtggtgcagagccctgagctaggagatgtttatcactgtttgggaaaccagaaccctcagcctttctcccttctgcctcgcctgaagacaggtgagtcctttgccataatatgaagtcttaatttagcattgccacattctggttccagatctttccctcctggctgaatattaagattgcattttgtctcttgtctttcttggtatctcttccctatgcaaacttcatggacactggaaggactacaaaatcctgaaaatcaagaaacctccattgagaaagggggttttactagaacaaaaatgtgtagagatatatacaaaaattatatataataatgtctgtctctgtaattattcacacttagcaattcccagcaccttctccagaggacttccctaactaaacaagaaaggtagtctttggggaaagtgttttcatcaataaaagacaagctatgtgtgagttattcctgcactgggcagcaaggagtgggtagttacctctgccttcgagtaccccttcatttgactaggacctgagactctctcatatctacttccaagcccaggttgagcacttcttttctttcctttctttagttgcttctactgtgaggtatagattttacatccagtcactgctgaagactttcatcaactcatcactcatccttcagtcatctcacactgagaacaactgggagcctcccgttttcctgtttctttaacatttgtcagaatctccccaaacctctaacacctttttttcagcagggggcagtaaaattcaatttattttttctgttctcagcacttactattaagaccagatttcatagtaaagtctaaggccaaatctcattaatgattttaatggttacttttgtcttaaaggagcccctgataggacaagagtatttcagggtttggtaaatcaaaactgttatattccttcgtgacacatgacagaggaagagtaagcaggggcccacatgtgttacatgtaaatacatacagacttgaagacatggtgttcaaatagtagagatataatagtaaaaacccaaagcctatgtcagcatcatgtgaacaaaaattttagtaaataccaactgtagatcttagtgaactagggcaaaggaagtggacaacactgggagaaattctgggattaatctttgtatctcacaatcaaaaccaaagacttttctgttaagaagaaatgggggaaagggcggagggagaatggcacttggtttagacattgtttactgcagcagcacccaaaccatttgtagcagtattaccaaagcatgtattggattatattttctgttctgtcatgattgatagtgcaattaaaggcagatggactaaaatcatcctaggcaaaggctaagttgataaagctgataaagcctgaacaccaagtcagtgaaaaatgagactgagaaagttattatcacacaataataacaccattctgaggactcagtgaattccagttactgctccaagctctttacatgtgtctatataaatagattgccccgtttaatgctcacaagttctcctgctccttgtctgatcaagccacgctgttcactggttccctcttctgcatgttcttctctcttgggtttgcagagttcattcctgttcatccttcagaacccaactcaaatgccacttcctttcccaacctttttaattaggtaaaatcttgctattacaggcactcaaagctatgtagtttttatgttcatagcttacaaaacagttgcaatggaatgttttgtaagaatattaaagacttgagttaagataagcaaagcatcaagcctactttggatgagggaagtcaacaaaaatattactcatttgatgggttaaaaggatatagatgaaactgtttcaacaggatgtctgtgggacccaggaagtttgcaggggctgtgtcatcacacacacacaatgacattatcaagagcccatcctgcttccccactactgggagacatcctctctagccccaactgtgccatgactatcaggctcctctgctacatgggcttttattttctgggggcaggtaagtcatagacacagttcattccaaaatctagaaggaataattcctctttgttgggtttgtgcctggctcagcatcaaagtccatcgtgaactctgttaccaatttttgtctcttcccataggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatacacagtgctacatggataccgacactccgcacagaaagggtcgcctctaatgtgaggacatcttgcctccagaaacctcatcttaaactacagaaacccctacaaatcttcccagactcctcagccttgagggaccagtgtgctttaagtaacagtctggactaaagactatctctggctcagtctctaagaagctgagaaatgacccagccccacagtcatcctagctgactttttccttgcatctagttgttgttgttcaattgagcttgcacaaattttatccttcaagataaatgcgataatatttgacagttaccttatggctagctgaagaaagtctttgtcagctaagaaacaggaaaaggatcctttgactttctacacaggctgtctttatctctggttcatggtttcttcctcatgttaaacttgttccttcatacacagccacacaaagtccctgccctttcctgaccccagtcctgcacctgacggcttcagttcctcaatctatgactttgaacttagaataaaattttattttcacttgaaataagtgattaatgattattttcactaatatccctctaaataaatgtaattttagctatatctgcatgaggcctaaggaaaagaaaaggctccaactttggcaaagaatagtctttaacaatgtccctggattcagccctaaatctctttggagactacccttagcattggaagactatcccacggctaggtgattcttctgtcttggatatgctgaatctcagggaagtgttctctatccacatgagatcagacctgggaccctgaatagatttatttttcacagaagtatagactgctgtggagccctgggtgctgagctcagatgtgaaatctctgttttgaggttaccaaaaagtaaagtcacagagtctctgtcctggttttgcctccttaaaaagtagctttaatatgttagaaaagaatctagaaaacatcatacatattttattataaaagtcatttcttgttcattcttcttttctgtttgttttctacgatactagccattcctcactcttctttgtaggctctttctattctcattttccttattttgaccttatttctggactttttgttcttttcctcttaacctatacatacatcttagacaatatcatccaatctatttcttgaagcatatgtctcattagtttcaaacttattctctagctgcctactagatatttccacctctatatttcataggctcctcaactcagcttgtccccaacagagttcatcatcctcccaatagcatatcctcttttggagacaccatcatcttgggaggctcatctccaatggtcaggtgtccttagcaaacacctagaagattaacaaccctccttactgaactcttagcctcgtgccttacccttctggccttcttgcaaaagtgatatgcatcagagagttggccctctgtattcatgagttccacatccctggattcaaccaaccacagatcaaaaatatttttttcaaaaatcgtgtctatactgaacacatacagacttttttcgttgtcactattctaaacaatacagtataacaactatttacataacattgcattgtatttggtactatgaattatttacagatgacttaaagtatatgggagtatatgcatagattatatgtaaatactaaaccattttttatcagggacttgggcatttgtagattttgttatccttgggaggtcttggaaccaattcaccaagacactgagggataactgtagacaaatatgatcatgctactggatcccttcaccatttctccatgcttctccctcatattcaagataaaatttaaatttcttcacctggcttaatggtattttgtgatctggactccagaaattagcttatcttgaacaccttatcctagctatttttcatcctggcaatcctgaacttctgaccattttctatagtccatgttctcttacccatctgagaccctgtacccactgtccctctatctctgaagtctgcacttcttgtctacagggctgactcctactccagcatctcattaatcactatgctaacacaagaagtcttcatctgcttcagttctcaaaagaagtgaaaagcagacacttctcaaaagaagacatttatgcagccaacagacacatgaaaaaatgctcatcatcactggtcatcagagaaatgcaaatcaaaaccacaatgagatatcatctcacaccagttagaatggcaatcattaaaaagtcaggaaacaacagatgctggagaggatgtggagaaataggaacaattttacattgttggtgggaatgtaaactagttcaacaattgtggaagacagtgtggcgattccttaaggatctagaactggaaataccatttgaaccagtgatcccattactgggtatatacccaaaggataacaaatcatgctactataaagacacatgcacacgtatgtttattgcagcactatttacaatagcaaagacttggaaccaacccaaatgtccatcaataatagactggattaagaaaatgtggcacatatacaccatggaatactatgcagcaattaaaaaggatgagttcatgtcctttgtagggacatggatgtagctggaaaccatcattctgagcaaactatcacaaggacagaaaaccaaacaccgtatgttctcactcataggtgggaactgaacaataagaacacttggacacagggcggggaacatcacacactggggcctgtcgtggggtggggggagtggggagggatagcattaagagaaatacctaatgtaaatgatgagttaatgggtgcagcaaaccaacatggcacatgtatacatatgtaataaacttgcatgttgtgcatatgtaccctagaacttaaagtataataataaaataaaaataaataaatatttgtgaagttataaacttttatttgcaaggtatctagaagtggaattactgagtcatagggtaagggtataataaattaaaaacaaaaacaaaacttgtaaaatgttttcagaattggctatttcattttacatttctgtcatcaatgtgtgaggttccagttttttcacatcctctccaactcttggtcttttttaataatcatgattctggaaaatgtgtagtgtcatctcactgtggtttttaaattttgtttctctaataactaatgatattgagcatctttttgtttgcttattggttattcctatatgacctctgatgacatacctattcaaatcctttactcattttaattggatggtttgtctttttatttactgagttttaactgtcccttatcagacgtatgactttcaaaactttttttcctgctctgtgatttgtcttctcattttcttaacaggtgactttgaagataaaccattttttattttgatgaggtccaatttttcaatttatcttttatgaattatgcttttcctgttacttctaagaaataactaagccaaagtcataattttttttctgtcttcttctagaagtttcatagtcttttggctgggtgtggtggctcaagcctgtaatcccagcactttgggaggctgaggagggtgaatcacaaggtcaggagatcgagaccatcctggctaacatggtgaaaccctgtctctactaaagataccacaaaaattagcccggcgtggtggcgggtgcctgtagtcccagctactggggaggctgaggcaggagaatggtgtgaacctggcaggcggagcttgtagtgagcccagatggtgccactgcactccagcctgggtgacagagcaagactctgtctcaaaaaaaaaaaaaagaagaagtttcatagtttttgctcttatatttggtgtacaccatgttctgagttaattttggggtatggtgtgaggtaatgatccaagatccttattaatagtattagtatttttgcatagtgtaatttctgtactatctgttgaaaatattatttcatcattaaactgactttacaccatattcaaaaatgagttaaccatagtggatgggtttatttctgatctttgttgatcttatgttaataccacactctgttgattattacagctttatcgtatgtttttaaattggctagtgtaagtcttttaactgtgtttttctttttcaaaattgccttgactattcaagtcctgtgtatcaccatataggtttaggatcagctagtcaatctctacaaaaggtactactagaattttgagaaggattgctgtgtacttattgataaatttggagataatttctatcttaacaatactgagtcttccatgatcacggaatgctttttccattcctctagatcttttaaaatttatctcaacacttcatattttttccatgtatagatcttacatttctgttgtttaatatattgcaaagtgctattttctataatgtaagtataaaactatttttcttaatttcagttttggattattactagtattagaacacatatgatttttgctatacatactgtatcctgaaatcttgctaaatggatttgttctagaagtttctttgtagatttcataggagttattttttttttttacatacaggatcatgtagtctgagactaaaaagaattttactttttcctttccaacctggataccttttattgcaatttcttatctgactgtactgtctgacatctccagtgcaatgttgaataaaagtagtgaaaacagacattgttactttgctaccaatattataggcaaagcattcaatctcttcaagctttcatgtttaaggtgagtgtttatttctttcatgctgttagtcaggatgagagagttcaatctgttcataatttgttgagattttattatgattgggtacaggttattttgtcaaatttattttattgcacacattgagataataatctgatatgtttttattctattaatatggtatattacattagttgattttggatgtcaaggcaatcttgcattggtgggataaatcccacttggtcatagtatataatcttttcatatatggctaaatgaggtttgctaatattttatggagaccatagacatactagtttgtagtttttttgtgatttctttttatttagaatcaaagtaattctgacctgttaggctgaattaggaaattgtggactgaacttggatgaatttaggaataatctcttattctttattttgtggaagttttttcttgtaggagtggtattatttaaatatttgatggaatttaccagtaaagtcagctagtcctgagcttttctctgtgacatggagtgacaaactattgctcacatgttaaagtcaagctatggcctatatttgtattactcataaactaagaataaattttatacttttaaagtgttagaagacggaagaggaggaataggagaaaaagaactgacagaggttgcatatggcccaaaatatttactatctagctccttactgaaaaattttgctgacctctgctctatatggtgttatttactaaaatacttctttacttgtaatatgtctatccagacatgtggctttttttctcgagttactcttatgtctttctaggaatatgtctgcttcacccaagttgtcaaattcattgacatagtgttgttcataacatttccatatatttctatagggttagtaattgtattcttcattttcactcctgactttgcaatttctattttcttgctttttatcttgttcagtctgactaaagtgttatcaattttatagcatttcaagtaaacagttgtagttccattgattttctctattatttttctattatctattgaattgatttttaatttgatctttttttttttttttttttttttttgagatggagtcttactctttcgcccaagctggagtgcagtggtgctatctcggcacactgcaagctccgtctcccaggttcacgccattctcttgcctcagcctcctgagtagctgggactacagccacccgccaccacgcccagctaattttttgtattttttcttttttagtagagacggggtttcaccgtgttagccaggatggtctctatctcctgacctcatgatccgcctgcctcagcctcccaaagtgctgggattacaggcacaagccactgcgcccggcctaatttgatctttgttatttcttccttatgtttacttttggttgacttttctcttatttttccagtgtcttcaggtagaagtttagattatgatggaaacttttgtagttgttttcctaatgcagttatttaaagttatacatttccctctaatcatggctgcattccatgtacattgatatatttttagttttttagttaaaagcataatttttctagaaattccttttgaagcccatgagttatttaggagtgtgatgtttaatttccaaatatttgtgatttttccagcttctttctgttgtttatttctaattaaatccctctgtgatgagagaatatactttgaattattttaatcctcctatctgtatgttattatataacatataatctatatggggaaatactctatgagcacttgaaaaagtgtacattctgctgttgctgaatagtgtgttctaaaatcatcaattaagtcaaatagtttagtagtgtttttcaggtctttttacccttatttactttctgtctagttggtgtggtcaatttttcagactggaggatttaagtcaccaactataattttggtatgtttatttttgtttcatttctgtcatttttactttatgtactttgggactctgttgttaggccccaggagttactccacaatgctgtacgggcaaatgctttctatactaaaagtaactaaacttagagatttgtgagtaccatcaagcatacccatatatgtaaaattggagtcttagaaagagagaagtgagaaaaagacaaagaaaaaataatggccacaaacttctcaaatttgttgaaaaacattaatcaaaagaatctagaagcttaacatctctcaaacacagtaaacacaaagatatctatgtctagatacattatagttaaacttcagaaagccaaaatccacaaataatgtattgaaatcaatatattttttcaacaagagaaaaatgactcatcatttgaaagagaagagcaatacaattaatctgactttaaatcagaagtcattgtttctgactttaaatcagaaacaatggagatcagaagataatggagaggcactgaaagaaaaaaattccaccaaaaattctatatccagcaaaactatcctctgtaaatgaaaatgaaataaagacattcccagataaacaaaggctacagaattgtgtggttagcagacctgtcttacaagaaatattaaaggaagtcatccagctgagagaaaatgacattgttagcaactaaaatccatagtaagaaattaaaagcaccttaaaggataaatatatgtgtgaataaatataaaaaatacatatgcacaaacacacatagaaggaatatatattttgtatattttttatatcatttgatatacatatataggttgaaactttaatcattatgaagtgtttttctgtaataatattttttgctttaaaatttatttctctgatattaatatagccactcaagcttttatggttactaatatgacatatgcttttccatactttactttcaatatatttgtgtctttaaaactaaagtgatttcccatagtcagaaaatagttggattttggtctttctattttacaacataaaatcaactcaaaataaattaaagacataagcataagacctgaaatttttaaaatactattagaaaacataggggaaaagcttcttaatactggtcttggtaaacaatttttagatattactgcaaaagcataggcaacaaaaaccaaattagacaagtgggattacatcaaactaaaaagtttctgcacaggaaaggaaaggaaaggaaaggaaataatcaacagaataaaaaggcaagctacaaaatgggagaaaatatttgcaaaccacatgtctgaaaaaggattaatatccaaaatatataagaaattcacactcattagcaagaaaacaacccaattaacatatggccaaatgacctgaatagacatttctcaagagaaagcatacaaatgaataaatgtttatcattgctaattatcagagaaatataaattaaagccacaatgagatatcacttcacaactgatacactggctaacactacaaagacaaaagataacaagcagtgataaggatgtgcagaaaagggaatcatgtacattgttggcagaaatgtgtgatggttaatattgagtgtcaacttggttggattaaggatgcaaagtattgttcctgggtgtgtctgtgatggtgttgccaaaggagattaacatttgaatcagtggactgggaaaggcagaccaccctcaatatgggtgggtacaatctaatcagctgccagcatggctagaataaaagcagacagaagaatgtggaaggactagactgtctaaatcttctggctttcatctttctcccatgctggatgcttcctgctctcaaacatcggattccaagttcttcagtttttagactcttggacttaaactagtgatttgccaggggctcttgggccttcggccacagactgaagactacactctcaacttccctacttttgatgttttgggactcagactggcttcctggctcctcggatggcagaagacctattatgggactttacctcgtgtttgtatgagtaaataccctttaataaactcctcttcatctatcctattagttctgcccctttagagaaccatgacctaatacagaatgtaaattagtacagccattttgacaaacagtatggaggttcctcagaaaattaaaaatagaactatcatataatctagcaattccagttctagatataaatccaaaggatatgaaatctgtatgttgaataaatgtatgtactcttatgttccttgaagcattattcacatagccaaaatacagaattaacctaggtttccaccaagggatgactagatgaagaatatatgatataaattctgtatatgtatatataaatatatatattatttatacgtatatgtgtatacatacacacatacacacacacacacaatggaataatactcaaccctacagaaaaaggaaatcatataatttgcaacaacatgtttggacctggagacattatgctaagtgaaataattcaggcacagaaagacaaataatgcatggtctcacttattcatggaatccaacaaagtcaaacccacagaagcagagagtagaagggtaattgccaagcactgggatggggtttcaggaagggaggcataggaaatagggaaatgttggtcaaaaggtacatgttttaatcagacagaaagaagttctagagacctaatatgcagcatgattactatagttaataatatatgtactcttgaaaattgctaagaatgtagattttaaatgttcctaccaaaaaaaagtcaaaacaaaataagtatgtgagattatgcatatgttagcttgatttaattattccacaatgtatacatatattaaaatgtcacaatatcacattgtatacaataaatatatataatttctatttgtcaattttaaataaataataaagaaatgagatagctttcaactaagcttatatagcagtataatataaaaatttttgtagtaacaaaattatagtaattttggcttatattgaaatgtgcattaaacaagtgtttgcataaaatataattcaaattactattcatagcccacagccatgaaaacatgtgtgccttactcttggtacagaaacaaatagcttttactcctaaggaaaaaagaaaattcctgccttttgatgagaattgtttgagttttatacttattttatggggaactttgctgacctcttcattccaccatagctggttattcctcccttgcatgtacttttgtttcctgggggcagtgagtcttggaaacatttgggaaattcttattctgagcttgcctgcccacagcccaggttccttcctggagtctgcagcatcaggctctctcctcggctctctttctgtcttctgtcccctcagctcataaaccccagctcgtagaagctgaagccacctagactctaagacacctgattgcagagacaggaaaggagttctcaagataagtgccaagatttcatactggttttcacaagaatcagggttggaattagagccgactcattattcagttaacattgacattgttgattagagacatatccctattgaaaatatttcctggcaaaaaatagaagttctctttggctctgaaatctgcaactccctttcaggtgtccctgtgtccttgtaccgtcactccacagcactgcacaggcatgtgctcacctcacaaaatggcagtctcaaagggaggagtgcccacccacaagaggctccaccctattctgagaaagaacttctttcagaggaggagagaatagaactttccagaaccttttacatgagatttttttttttgggtaggaagtctgacctgagcagcaaccttgcatcagacttcaaaaggcaatatttcctatacctccttgtgctctactagtgagtacagaagtcgagaaaatgttcctaagtctatggccagttcaaatagtctcattttctatttctgagattaaattatatgtattaagatccttactctgccctttcaggtttattgctcctcagacaagatatcccctcttcaggtcccaaacacattcattgcaatgcctttcctcatccttgtcccagtcctggctctctagcttcttgagacaataacccaccctaaggtatgttgtgacatgcatcttctgtgtcactgggatccctaagtggtacaagcattcactcaattgctttagctagagtccccagaatatcttcacctcttctgtcacattcttcttccacattggtccataaacacatctttaacatttctgtttattaaaacctctcaaattcaaccactattttctatcccaacgaatactgccttagctcaggcaaccactgtcttcgatctgaattacttctttgacctgaattacttcaactcctaccaaatatccacctacctgatgtcttactctcttttctaactcagttcattctctgcagctgaaaacacttcctttccattgactttagggttatgaccagtcttctttatatctaaatgttagcctataagttttttcgtaaaaaaaaaaacaaacttccaaactacaaattcttaaaaccctccatgatttggcccttgcatacctatccagtcttgtgaaattcacctactctttacccactttttgcatacttatgctctaataatattcataatccctcagctctcccaaagctccatatgtactttctcactcactcctgagcctttacacatgctgttcacactagctagaataatctttctctccctatttatctgtactcctaatccttcatgtttaaatggcataatcatcatggctgagtctctgactatgcgtggtaaataccccatggtacccagagcttctacaatcatagagtatcacacatttcattgtttaacttattatgatagtttttaaaattattaatacaaaatatgctcaatgaggccaaggaccatgtccaaggttttaatttttgtatcttcaacagtattacaggctttgaataaagtaggtgctctttaaatatttattgaacaaaccagggttttatcagttcttgcttccctagctaagatatgatctcagtcatctaaacatttctctctcagaagtattgctgcagttatttagagattttcacattgtggtagactgaataataatctcccaaaatattcagatctgaatccttgaaaatcttgaatatgttctctcacattgctgaaaggattttgcagatgtgattaagttaaggatcttgaaatggggaggttttccttgattagctgagtgggctcaatatcatcacatactttcctaaaatatcttacctaaaaccacctctgtgaagccctctttcttttcccagacagatatggaggtttctttctttatgtgtttataataaattaaacaaacttcaacttctatcactatgttatgatatttatggtcatgtctgactcttcctagactagtatggtttttgagggattggactatatattcgcttacctttgtaaatccagtatgtaggacttggtacaatatattggatacagaattataagcccgatgggagcagacacctttatttgttgttcatgcttatatcccagaatctagtactatgtctggtgcatgtagtaagagtgaggcaagaggatgcaagtcagaaaaaggctatgtgacaatggaagtagagatcggaatgacagacacactttgaagatggaggaagggccctgagcccagtagtgcagatggcacctagaagctggaaaaggcaaagaaatggattctcccataaagcctacaaaaggaacaccacctgccaacaccttgatttttagccccataagactcatttcagacatttatcctgaacaggacagaagcaaaaaaatggaatcgatcaacataaaagcagaagtgaataaggtagaaaatgttttaatgatagaactaagaaataagcaaatgagataattgtttgccagccaaaagacagagaggacaaatacactaaaacagaagtgacaaagggaagtatcatgataaaatctatttttaaaaacaatattttgtataattctctgcaaacaacctaaaagcctaaatgaaatggctcacattataaatttagcaaaactgaccctaatgtggaaaaaagcctaaacaaaacaatgactacaaaagaaataaatgaatttgtaatagaatttcctcacagaaaagtgccagtcccatatagtttcttacagggatttttccacaccttttaaaatcagggactttgagaatacctaaaacattgcaaagtatagaacagtaggggaaatttctaaattattttcatgacatgagctaaatattaaggtgcaacaaaactgcaccttaaaaaaaaaatcaatctatagactggccaggcgtggtggctcatgcctgtaatcccaacactttgggaggctgagggtgggggtggatcatgaggtcaggagatcaataccatcccggctaacacagtgaaaccctgtctctactaaaaatacaaaaaattagccggttgtggcagcacgtgcctgtagtcccagctactcgggaggctgaggcaggagaatcgcttgaacctgggaggtggaggtttcagtgagccaagatcatgccactgcactccagcctgggcaacagagcgagactccatcttaaaaaaaaaaaaaaaaaaaaaaaaaaaaaaaactatagacttacatcactgattagtattgataaaaaagtattcaataacagagaatcaaataatgacactagaaaataatctacaaattggtgtttgctccaggatggtaagggtatttcaatattagtaaacttactcttaaaatccattatattagtcaatgggtttggcctgagcactgggaaagggatgggtaggaaatactgtctcagaaaggcattgagagagaacacatcctaatcctatctggaaatttacactccccttcagccattcacgtctcttaacaatagtctccagctttactgaactctttgcaaactccaaaaataccgtattctcttagatattgcataggctggtcccccagcctaggtctaccaggaaattatttgttttcctacaaatcttacttaaacccacactacctctgtgaagtcctttcttcccacggagatatggaggtttctttccctatgtgcttacaacaatttaaagtctgttactatattatggctttttggtcatgtctgactccttctaggcaagtatggtctttgaaagatgggactgtaaatctgtttacctctgtaactgcagtagtaggactaggaatgatatatagaatacagaatcataagcccccatggaagaagagaccttctttttgttgttcatgcttgtatcccagagtctagtactatggtgcacatagatgtatatttgttcaataatatgaaagactcaaatatgcctttgtggaattgaccctgcacttatgcctcaccatctcctacttaccccggaattatttattaactatctcatgtcttaggtctcatctcccttccctagttaagagtgggccctgttgctaagcaggtcaaaataggaggctgatgaagaaaatctctgtggaaaatgctgaagaggaacacaggaataaaaatacctttactctgatgatgccttatataaggacagatgcagttggtttaaacttctacattggctcatttctatgaatgccacacctctcaatttcagggacttcccgtgaggggcttcacaacaatctctgggctcagtggggagctactcccttggtgaatctcctcactgccactcaatgagccatcagggtgggccgtcacctctgctaagccacagaggtacaccacatcctgctcctgagaggaagggaaagacagaggatcataggaagtaaaccccttgagggaaatttcaatgtggaatttattctgtttcttgagtagcatatatattttccccatctcagaccctaacctcaagtgaacttactcccagactcacacacataaatatacgcaccagcaccatcccagcaaggaggcagctgcaacaaaaagaagcaggtgggagagtattatattacatatttaactacaggatcactccaagaattacatcccctaaaattattccctccattggaagcagactagtagccaataggaagagaaattgctaaaacaaaaatgtgttcagttggatgaagtatttatttaaaacagaaatgtatttatgaagacataattcttcagaattatattataagctaaaaataaaatcctatacccaccaactgactgaaaggaccatctctgggacaagggcaccccagagtaaccttgaatgttgagttcttggccaggacaggatggagggatcagacacaccttattatacctctcctttagagccatgatgaggtttgcttccctaaaggctaaacacaaaccagccctttgaaaagactctagcactaaaagcaacagaaagtgtgatgctgtccctcctttttcctggtaaaaggccaccaaccaaacagtgtttctggccagtctatggaggacgtgtagtgaggcttttggtgtcctttgcttcaccttttgatgtcagagagctgaaaactccacccccagatcatgctaacatggccagtttttttttacaggaatcccatgaaggggcaggaaactcaattgtggatgtatatgtttttccctttattaatattcatgactcctcctatagcttattgaatatctgtatttggccattccactcagcatgtatttcttttccctttgcctctccctagatgtgtgtttctggcttctggccagaggctgtgcttcccagcctgtcagaatggccacactgcaggctgcaaccctttatgagaaataaagctctcccttccaaatttgaacctcctcattcttccattgacagtatcaaagatcagatagttgtagatgtgtggtattatttctgagggctctgttctgttccattggtctatatctctgttttggtaccagtaccatgcgttttggttactgtagccttgtagtatagtttgaagtcaggtagtgtgatgcctccagctttgttcttttggcttaggattaacttggcaatgcgggctcttttttggttccatatgaaccttaaagtagttttttcaaattctgtgaagaaagtcattggtagcttgatagggatggcattgaatctataaattaccttgggcagtatggccattttcacgatattgattcttcctatccatgagcatggaatgttcttccatttgtttgtgtcctcctttatttcattgagcagtgtttggtagttctccttgaagaggtccttcaacgtcccttgtaagttggattcctaggtattttattctctttgaagcaattgtgaatgggagttcactcatgatttggctctctgtccattattggtgtataagaatgcttgtgatttttgcacattgattatataatcattcttctaagaagataccaatgaagtttcaaggatgattcagcatgataatgaactgtttgtaatcattcaagatatactaaatgctgaaggaagtcagttagaaataagaagtaggacaaccaaaggatagaacctagaagaagacaaagaaaggattttacagaagctgctcatgaaaagagatccaccaattctgagataaaagaactgggtttgagtaagccacttgttataagcatgctcaaggttttcagaaaaaaataaacagagctagtcaatgatacctggtaataaaagatattttgaatttcaggccattgagggtagcatgctaagtgtggttttagttttgggaattagagtaaaatgaaaataatttctgaagaagtctccagccaaactttaaaaagaaaaaaatgcaaggtatagaatatttgaaaaatttattattaatagttgaaagtacatattttagaactggactgatctggtcaccgtctagttttgccatgttacttaacctctctaaaggtagtttcctagcctataaaatggaaatagtcatacctggctctgagaggttttatttagttgagaaaatgtatgtaaattgcctgacacaatccctagccaagaataagactcaataataactaatggcggtagcagtaagagtgctactactagctgaccattctgaaagttgagcctgagtgagtgataactatacactgtgcagttgtaacttcttaacacattaattcatgtaatcttcacagcaaatccacaaggttcatacttttattagtacaacttacagagagtaaaactgaagcattcacagttaacttacttgcgtaaaatgagcttaagtagcagaacccatatttaaacttaggcactctctctccagagctttctttgttagccactaaccttgtggtagtgcaatcaagtaaatgggtttgttgtctgatatgctcagaagccaataagcatggcaccagcttttgagaaaagaaaaggttttactgcaaaactggtcagcaaggagaaataagccggctcaaatctgtcttcctgattcggggtcttggacaagttttaagggactgagagcaaggatttagtgatactgggttgacagggtctgattggagggtttcagatttaaccatttatggtaaagtaggttgaggcagatttgagcccggatctttccagccaatgaaccccttgcttctgaaagagtttcagcatccagattccaagcatcttcctgtcttcttggttccgaagggaggaatcgttcgttccaggtgttatttgaggtcaaagcttttggctctgtcgtacctacaagctaactcatattttgttatccacataacagacccagtttgggctgatcctgcagttacaaatccctccctttttgtttactttagttctcaatcttgaagaaatagagtgtctaccactctagctactttttgttgacaagggacataggtctgggtttgaggaatgaaattgtttcataaataattgcaaatattcataggtcctgagttgaggtcaaacaggtgggtcagggaattcgatatttaataactatttcatgagcagggggaattgatttaacaatcaatttaaaaaatagacagcaggtagagaccttgagagaaggaagagaaatcttaacacatacagaaatataattttgagtttaagtagaccctcaaaaaatagatcttattcctaatgaaaacacgctgtttacatattatatccaggttttttagagaacactagatggcgtcgagtggcttttggtctattatttgggtgggtctcaacttttttagaagtattaatgtaaacacagcatgacatattaaagcataaacacctctttgtttagccagtatataatctagagtaattttattatctattattactttagccaaagcacctggctctctctattgagccaccatggccattgtggtctccttggcaagctttttcagggcaatggaaaggtttttaatcatatgtttataagaagcaactccccaccatggcaacagagtttgtctaaagaaatatcctacaccatctggtgggccacctggtaaatatttaactgggaggaggtttagcatagatcttttggccaaggtgaacagttttatggtgttagtctaatgcccagcatcactaatgccacagacagagaaaggagtgactaagtaccctagtaaacagatgtctttggggcatcagctgtcaaggcattcatagtccgagggctggtcgtttgtttcatagacaaagacatatcctgaggaggcgcatagaataccagatatgttgccgggcgcggtggctcatgcctgtaatcccagcattttgggaggccgaggcgggcagattatgaggtcaggggattgggaccatcctggccaacacggtgaaaccccatctccactaaaaatacaaagaattaaccaggcatggtggcggacacctgtagtcctagccactcgggaggctcaggcaggagaatggcgtgaacccgggaggtggagcttgcagtaagctgagatcgcgccactgcactccagcctggatgacagagcaagactccatctcaaaaaaaaaaaaaaaaaaaaaaaaaaaaaaaaaataccagatatgttaacatctaagttctcagtttcaggaattttacttaggacttggtcaaagtaggagtcagagtatagaggagtctagaaggagttatctaacttacaaattggtagggaagagggcagtccttgaaggcatactaggttctttttatttaactcttgatgtaatcatgtagatctacagtttgaggacacatcagtgtatatctcctggaccagaggatagaaaacaggaagtggaaaataggtgtgttaagtaaagagatgattttcgtttctgcgttagccagtgtctggcttctgtgggcatgggcccctttatcctcagttttaaagctgttaacataagtgtctttgcaggggatgttaatggaaaacagggaactaatgatcctcccccagcaaatctgaccctacaggttatacctgtgggttttttatcataggtcaccagaatattaggcactttagagaagttggtcacagagataagcagcagatcagtgtgatcaagtgcagaggagggtttttgatgacatctctaacatttagatagattttgtgaggtaggtagggattgggacatttttatcaagaaattatctttttggccagtcatggtggctcatgcctgtaatcccagcactttgggaggctgaggtgggtggatcacttgaggtcaggagtttgagaccagcctggccaacatggtaaaaccctgtctctactaaaaatacaaaatttagccagatgtgttcacttgaactcaggaggcagaggctgcagtgagcgagatcatgccactgcattgcagcatgcacgacagagtgagactctgtctgaaaaagaaaaaaaaaaaagaaggaaagaaattatccttttatgttgaggtaaggcaagcaaaaggatataatagaggaaaattgtgggcatttttaacagaggaaatcattttgtttccctgagaggagatatttggctgatagaaaaaaaagcatcagaaaaaaataaactctacccaaggaagggctataaggtcccaaataatatttttgaggttaaatcaaggaggtagagatgattaattcaatagcatagaatagtatatatgacaacaaggcaaaaattaagttgcattaatacaggcctcgcccaatatcttgggcaagctgtctcctttaattgtctcctgtttctgccctcacagttccatcagatggaggctggttttagagacagaaatggatttccacttatctggagagctaggagccctttggccttattgggttttttaaaaagtaacttaaaaaaagattaggggcttccaagtgagttcctgggtggaaaagctggttgtgggcctccacagccatctggtagacggtcagtctggtcctttggcttttcttatctgtgaagggcatgacctgtttgggaattttacaggggccaagaggaatcttctgaaaatgggaataacttttacccatgaatgatgaatttagggcctcaacacttttaactttattgctgaatggatcactaaaggaacttcataaggacctaatctgtttgaactgtagttggtcttcagggtagcggtttttctaggtcttaagttgtacttagtttcctagacttagacaatgtaaaggaacatctataggaaacattaaaacagctagaagcgtaattatgtatagcagaaaaagttatacccagagactgtacacattttatagcatctaatgcatttacccatcatgatcattttcaatattaaaacagtatttagtcttaagaagggttgtcccacatagaattttgtaggggctaaactggtgcttacttttaggggtcattcttactctaagcagggcaagtggcaagatcttatcctatgttaaattgggtttttgacacattttggcaagtactttttttaagatattgtttatcttttcagtctttctaatagactggagcctctaagaggtgcttaatttccactgtatcctaagagctccataaatgtcttaggtaagtctgatatctctgttgtcactttgaattgaaaatgacaatccaaaggaattatgtcttttaataaagcttgagttacctcagatgcattttttgtttgacatggaaagaccttgacccatctagtgaaggtgtctataagtaccgacaggtatttatagtttcctccagctcctggcataactacaaagtctatttgacaatcttgtcttgtttctgttcctcaggtttagacccctttgcctgctggaggtggttctgtctttggattctctgtagcacaaataagacaattttgggcagccttctggatagtcttttgtacgtgcagcctgacaacaaactttggtaactaatgataggttgtgtttcttctataatgagttctttgatgtaactgggaaataatcctttatccagtgctcagggacaagaactattccttgctcattgtaaacctaggcttcttgttttacactgttccctatccaaatcttgagtataagtatgaaatccctactggtttgctctttctagatttacctttgagtactgggtttaaataaggacagattcatacttggaataagtaccagagcctttgttttaggctctcttgtcctggctgtatgtttttctgcctgattggctagattattgcatttagttatctagctatcagtctcttggtgtcctgggccgtgcattatggccattttttttgacatcaaaattgagtctaataagtctaatatctctcttgtgtgtttaattttattttttatgagattaatgagtctgtcttttatatggtcccatttgcgtgcactaccaaaaagacgtatttggagtctatataaatggttaccttttcatttgtcctgaggtgtgaagcttgtgtgacggcaataagttctgccttttgggcagagagaactgatgggaaagcctcagcttttaacattctctggtaagtcactactgcatatctggcttttcagagaccctgatccatgaagctgttcacactggtaaacattcccaggcctgggtatttcaaaaactgatttgtcaagccagacctgtttttgtagatcctctttagggatttcaggcaatggtccttcttctacctgtaataaggcaacttggagggtgcagtcttgtttaggagacaccttaatatttactcattctggtgaaaaattactgtgcatttaattttgttagcaagtcttatcccaacaaaggtattgaacattcaggcatatataggaagctatgtttaaataggtttaataggcttttcctctatggcatttgagtggctgaaagaaaggtttgcaaggatgtttccccagatgcaccagtaatagcagtgttctttgggaagacagggacttgtgttgtgtttgggatagagtatgtagctccatggtcaactagaaaatctatgcatcacttttgcacaccaattgtcatctgcacttcttggtgggaaatgtttacagagctaatagagtgtatagaagtccctgggtctcatcattactggttgctatgagtaagctgtggcatgtggtatgttgatttgtggggagttttatcttaaaagactatagacaagtatgttattaaagtttcccattttgtatagagttttacctgaaatgactggaataagatcctgtaaaaaggaggtgttctggttctgtggtattgtgattatggggattcctcttcagagaatcaccaatgggctagatattccctcttatgtgtctcagagggtcctaaacaccagatggtattgggccgcttgagatgttggggttaccaaggccccttgtatgctcctcctggatgagctattgaagttctaacccaggaatggggtatgtttttctggtggggttgcctataaaatcactttacatcataagccaattgcctcaacacctctgccagactcttagtcacttaggaataccctaaaagggcaggagaaagcaatgtatttcatctttggaatccaaggactttcatttaaataaacttctaatgaggttcttgtcacaaccatcaaaaattttaacctctgttaggatgaataattatgcaaaccaaaaactcagaaacacaaaggaaaaccaaaaccaagccgaattgaatactcaaaaagttacagcaccttactattgtacttatttttttggatgctaacccaaagccaggactgaaataatctaaccaggacctccctagggtaggattcaaaccgatgaagctgcacaaaaataggactctaatctacagtcctagaccaaagacaatttaaggtgtaagcacatattaacaaggtattgactccaaaagacatcttatccagaagaatttctttcctcaaaagagaaagtagcactcaaagggcctgaaatgtcatgacagagaataaggacctcacagctaagcctctggataaactggtctaagtagcaccactcagggtcagtgaagaaactttaattcccactgaggggctacagtgccttggcaggtgttggcctcacattgggcacctatatttgttatcaaacaaatgggtttgcacacagaagccaataactatggcaccagcttttgagaaaagaaaaggctttattgaaacaccagtcagcaaaaagaaaggagtgggttcaaatctgtttccatgatttggggtctagggcaggttttaagggatcagagagcaagggaaaggatttaggaatgttgatatggtagggtctgattagaaggcttcaaatatgactatctatggtaagatatgttaagaaacattttagcccgggatcttctgggccagtggaccgctcactactgaaagaggtctggctttcaggttccagtcatgtcttggtcttcctgtttctaaggggaggaatcttcggttctgggtattgttagaggtcaaagcttttactactgcacatgcctgggctacatgatttgcagttatgtagctgttggcagtgtgggagatgagtgttgtttctctggccaggaaataaatgaaaagtgctggttatcagggactaaattcatcacagcaccaagcaacatcctgcttttggtgctgccatgagcaacaggcttctctgctgtgtgatcatttgtctcctaagagcaggtgagtcctgggcacaggtaaggaatccctattactgaattcacaggatctaactataaaatgtttcttcataaaactcacattagtctcctctttcccaggccctgtctctatttgatcatccatttttccccccaacaggcctcaaggatgctgtagttacacaattcccaagacacagaatcattgggacaggaaaggaattcattctacagtgttcccagaatatgaatcatgttacaatgtactggtatcgacaggacccaggacttggactgaagctggtctattattcacctggcactgggagcactgaaaaaggagatatctctgaggggtatcatgtttcttgaaatactatagcatcttttcccctgaccctgaagtctgccagcaccaaccagacatctgtgtatctctatgccagcagttcatccatagcactgcatagccatatcctctccacacaaaaaaaggtgcataccaaagaggaaaagcctgccctcaaaattcctcaccccgaataagagaagtttcctcacaagtattgacaaaaagagccaaactctgtaaaatatttgaagagatttattctgagccaaacatgagtgagtgtggccagaggcagaggctcaagagggcgtaagaacatgtgtccaaggtgctcaggctacagcttggttttttggagacatcagacatcagtcaatacatgtaagctgtacattgtttcaatttggaaaggtgggacaactcaaagagggggcttccaggtcataggtggattcagagatttttcaggctggcagttggttgaaagagttaagttatcatctaaagatttgaaatcaatataaaggagtgtctgagttgtggggacaaaggttcttattatgcagatgaagcctccagggagcaggcttcagagagaagagattgtgtttcttaatcagacttttaaaaggtgccagactcataattctctcctggatcaggggaaaaaacctgaaaaggaaagaattatctacagaatgcagattttcctcatgatagacagctttgtagggccatttaaaaatatgtcaaaaaatatactttggggtaaaatattttgatttttttcagggcctgctgtgagtcatgttggtgtcttattgctacaaaaggtctgttttgtcacttgtaaggtctccattctaatgttaatgctggttggttgtgcctgaattctaaagtgaagagggtataatgaggcatgtctgaccccacttcccactaagacctgaactggtttttcaggttaactttggaatgctcttggccaagagaaggggtccacacagttggttgtggggcttgggattttatttttggtttacacaagattataccaaagcccttccctaaatttgatatgccctgcttccctctttccatttttgtccttctaggacatctttttggttgttattaaacccttagtttcttgtcaatatcccactagactacagggcatcaacatgatatgaacacttatcttggtttatttgtgatactatagcaaaatgactgagattggataatttgtaaacataaatttgtcacaattctgtaggctcggaagcccaagaacaaagcacctcagttcaatgtctggtgagggccttggtctctgcttccaagacggcaccttgagtactatgtcatcacacgagaaaagtgcctaagctagttccccagcccttttatgagtcactaattcattcatgagagcagaaccctcatgacctaatcacttctcacctcttaatactgccacaatggggattacatttcaaaatgaattttagaagaaacacattcaaaccacagcacatttctagacaaactttcagacacagatatagggaaattttaatgaaattgaattttaccaagtaaagacaaataacccagatttgcaaatacccttcaaagattcttcaaagcgatctcaatggttaatcgtgttgtttaggaaaataagaacagtggcagcaagacctcctcagtggtacaatggcctcagcagcagtaaaagagggtagtaaacattatgcagactttgtgtgggctcaggatcacccacagagaagaaggttatttgcatgtatgtgtgtaactgtgtgtgtttaagagaaatgaactatgtttatttacagggattattgaggagcagaacctcagttgggtagatgcaggtataacttttaagatcaatatccatgtctttgaatagataggctagagatacagatttactgagtagttccccaaagatgcatgttgggtgataaccacctatactagttttccaattactgcaaattcagcaggttaaagtaacaattgtcttatctcatagtcctgtatgtctgaagtccaagaaaagtggctggatttttctcagggtctcataaggcggaaatcaaggggtcagctgtctgcattctcatcaggagactggctcctcctcccagatgattcctagtattggtagaatttggttccttgtgacagcaggtctagggtcttcattttttattggctgtcacagacagcaatgagattggtcattagctccttgcagtttctttctggtcctcttgatcttcaaatgcacatcaaatctgtctcatgtttaaaatccctctgatacccacttctgcttcaagacagaaaactctgcatttaaagggctctggtgattagattaggccaacctgaatagtatttattttgtcaaataatgtaacataatcgctggggtgacatctcatttttaggttccactcatgctcaaagtgaaggacattatacatgggcatgagtcattggaggtcattcttggaattctgcctatcatatcaatggaggtcaaatgccaggaaagtcaagaatagaaattcagagagcatacaatcaaatacattaaattagaattcaaaactattcaagagatggttcagagttttggccatgcagtgcatcaaattttcttactactgcttaatcaaggacatagtgcagaagtagaatgaattggtctttattaaaatggaacaaagaccaggtcgaggaaggaaaggcaaaaaggtagaatagatttggctcttactggaagaacactggagattcaagacgagaaacaggattgttttagtccctgagttaacaaaagagaagaaagatgaaaccagaacagttgccaatgaaggagcagtgaagtggaaaggcagaatggagtgagtgtggagagcacttttctgaagagaataaacttagttatcagatgaaaagagatatataattagctttgtccttataaattttgaggtaacttactatggaaatactttttcttatcagttaattaatttggggggaggtagcacaatcctttgaaattccaataagtagaaaactacttattggaatttcaatgacctcaagatgaagccttgaaaaagaaatgtctgttagaatccagttaacaggagaacacctactgtgactattatcagcaagttggtgaaaacttcctgaagaagaaatgtgggatgatacagaaactaactaaagtctcggaacagcaaatagtttctcctcttgtgaattaattcaccttccacaattaagcagagataactcagggtacctcaaatacttatgagcttcacagaaatgaattgctaccaaattccattgatggaggaagataagaaaatgatcaaagaaaatgtaccttcagagaagaagaattgttgagaaggtagcagtcctttctcctttctctttccatgaggtagttgctattcattactttatgatggggactgggaacacaagaatcaccactcatggattaatgaattcaagatctatactttccattttgattccaaatttgaacttaaatttattcaggacaccaactgaacacttctacctaaaggtaaaactcatatcatatttccctcccaagatgcatttcctctgagttcctgacttgacagagtcatttgtttgtacaatatatgaacactgagagtcatgccacatttctttctcttttgccctggacatccaatttttatgcaagcactttcatttctaattcctaaatatcttagttctttgtttgctatctcaatcactgcaaccactgacatgtttatgcccattttactagcttaccaaataaatataaaaggtctcattaatctctctagttccttattaatcctcatttcatctaatctagtattattagtatacccaagtataatcttccaaattgcaaagatctgtttctatcactctttctgcagcatccttcagtggctcccccatggtctacaatatatacaatctaagtttattaaaatgaaaaaaattatgactatccctttaatattttgaaaaaaggaaaattagtcctttaccagaaaaaaatagcactgtattataatgtcaagttcacactagagtctaggatggtatcaaagagctctatatttttcttcttgagtcactttgatatcctcccacagtaagaccactatagttggtgtattagtctgttctcacactgctatgaagaaatacccaagactgtgtaatttataaagcaaagagggttaattgattcacagttccacattgctggggaggcatcagaaaacttacaatcatggtggagggcaaaagaagcagacaccttcttcacagggtggcaggatggagtgagtgccagcaggggaaatgccagatgcttataaaaccttcagatctcgtgagactcactcattatcatgagaacagcatggaggaaactggtcccacgatttaattacctacacctggtgccacacttgacacctgtggattatggagattataattcaaggtaaaatttagatggggacacagagccaaaccatatcagttgggtactgaggaggacatactgtattaatcatgccttcttattgtctgtattttctaatgttttgacatccatattttctgatgttttgacatctgaggacttgctgatcttggagggactgaccctctcagtgttaactcattcctagggatagcaaactactttccctagagcatgcctttcataccaaatcaaccaatccaaagcctctactccaaaccacctcctttattgggctctcatactctaagcccctattctcctaccctaattaccacagggccaggtactaaacaacttgagataatccctacactttggagcctgctcaaatttttaaactagcccatgctaagcctacttagcctgtgtaccctgcctccctcattcgttcagtgaaaaccacaataaaggttcttgccaatgtttcctgtcactccttctatcttctgacccactgttgtgattcttattgctatgatattttttctaacttggtcttgaggtctctctttttagactagccataaaccaatatagccattctctaggagacctctgactcaggggagggggagttaaattcaggtgtgagtgtcaggtgagacacagtggagcaagtgaaaacaaaatgcatgaaaggaagaaatttattactcacagaacccaaagaggttagagaggcctaagagaagtgtgaagatggcaggagctcatccagtttgggagggaagggagggtacaggcaaaggcaggaggagggggtgggcgaggccagtggaactattccttaggctttcctatgggggttatgagtcagctactttaaagaaaacgtttcagaaggagaaaacttacttgcaggactctagcattggccattaggctttatcatggtcagcagctctggagtgtgctgggttttgggtcaggggaatgagaaatagaccatatagccgacaaccacatagggagaagttttaactggggcaacgacgacagggtatgactgggtttcaaataatttgtttcaggccttaaaaaaaattggggccaggcacagtggctcacatctgtaatcctagcactttaggaggctgaggcaggtggatcagtttgaggtcaggagttctagaccagcctgatcaacgtggcaaaaccccatctctactaaaaatacaaaaatcagctaggcatggtggtgcacacctgtaatcccagctacctgggaagccaaggcaggacaatcacttgaacctgggaggcagaggttgcagtgacccaagatcatgccactacactccagcctgggtgacagagcaagactccatctcaagaaaaacaaacaaacaaacaaaaaactgggcctgtattgccctgcatagtgtgtcatgcccctttcttcttgggaatcgtaggtaacaaactgtattttcagtggcagctgtctcctcatccattagctctaccatacttgaataataatagcactcatattctaaaacacttgcttcttatgagtaggaagaatgggtcactgcttcagaatcccagacatgtccaggaggaggtgaaaaccaaatgagcagatcatacccagcctgattgaaacacacacaatatagtcagccctttgtctctatgtattcaccaactcttcaagtacacctatgtatagcatgctgacaaactctgtcttcttcaatctgctaaatcattttccactttcctacattgctgtgggccaggagagccctgggtgtagtggaaagtggggagtgattaaatccatctaggaaggagatgggtgggtgaaaaaaagtgtgtaacatatacaaaggtttctatgattacaagcctactatgaaatccagtcacacctaccactcacagtcccacttactttgctctaagccacactgaactctatctccaaacatgctgtgcataatatttcccttacacagcacacctgcaaattcctttcaaatataacttaaaacaatagcactacatgaaatgtgccattttcccaagaagattgtagactctttcccctgtattctccatagcttacacaattctccctttctacaaataccaaattatcatgtttattggtatagtgatcttaccatgggcctacaaaatccatgtggtcaaatgccacgcctttccattattccttccccagaatcttctcctatgcatgacatccatgtttaatgaatgatcagacacaattaatatgggaacagggatgctgacttctgtgtttatgcctctattctcagggtctgaaacagcacctgatatttaacaggtgttcattatgtggctgttaaaaaaaaaaaatcagcaatgtctacaatgatttgatcctgggtttgcctcttctctccttcttcctccaaagtatatttcttaaatttaacaacccttgccttccttttctgtctaagggctactggtaggtaggataatgactccgaaaggtgtctatgtcctaaacctcagaacctgtaaatatgttaccatacataataaaagataattaagtttgtagatagtttagtgtgctaattagctaaccttgaggcagggagattatcctgactcatgcaggtgggctcagtataaacacataggtacataaaagtgtatggactatggtgagagtgatgtgacaactttacctgctgttgctgctgaagataatgaaaggggccacaagtcaaggaatgtgggaggcctctagaagctagaagagaaaaaagaaaacattctctcctagagcctccaaagagcaaactgccaatgagaccgaccctggacttccaaccaaaagaactgtaagataataagtttgcgttgttttaagccactaatttgcagtaataggatacagcagtaagagaaaactattataaggctctatttccaagcagctgaaaaaaggcagctgatgaaagaagttgtgccgggaagtagcctaagaggcaaaagtacaaaggcaggagtttgaatcagacgatgccacttttaagggtggatttgtcagagacatgtgaaccacagcaactccatcttaaataggagctgggtaaaataaggttgacacctactgggctgcattcccagatggtgaaggcattctaagtcacaggatgagataggaggtcagcacaagatacgggtcgtaaagaccctgctgatgaaacaggctgtagtaaagacgctggccaaaacccaccgaaaccaaaatagtcccaagagtgacctctggtcgtcctccctgctacactcccaccagtgctatgacacaaatgccatgacatcaggaagttaccctgtatgttctaaaaaggggaagcatgaataatccatcccttgtttagcatataaaaggatataaccataaaaataggccacaagcagccctcagggctactctatctatagagaagctattcttttattcctttattttcctaataaacttgctttcactttatgctatggactccccctgaattctttcttgcttgagattcaagaatcctctcttggggtctggataaggagcctttcctgtaacagctttctggtgatgatgaagggactgtagtgaggaaaccctggaaagaaaggataactttgggtaagtgttggggtcctgtaacatcttcctggcaaaccctgaagggatgatactaagacgacctccccccaacccaaggaaatagactgcagcaccgattggacaactttgggtaagtggtggagtacctacccaggtaaagaatgggattgggatagaggctcaacttaggggagttagagtctctcctaagacagagagggttaaaggcccctcttaataaaaggcaaggacacttgaatgaccttgggttagaggcccgatttaggaggattagaatccctttccaagatttagggggttagtggcccttcttagaaagtctgtcttggtaaagtcctttcgggctaagaacgggttttgcactacaggatgttaactgctattctctttggattaatctgccttcaactccttgctgacagctgtgtgtaacaggattaggcatgtacaggatcatgggacatggggaactattttctccctaaaacagaaaacttgagagctgatgggactgctggaaaagatccttcacaaccatcatgcggccacctgaaccgttcagtgtcactgcaatgggtgggtctttctctggtgtctccgagtgcctccccttccccaccctgcctcaggcagtgctttcttctttctctgtttctctgtctctctctttttctccttgcaaactggttgaattaatggtaaaagtaactgtctcctataaagttttgattaatggaagaaagggtttttgaggctagacttaagctgtagcaaatctgatgtgctttgtgtgtttttctgtattattctgtcataaagaggggtaccttatgatagaacactggctgaggacacttgtaaactgcttttcaagacagaccagcaaactggtcagttacaaactttgctgtaggttcctgagaaaaattggatgagatttttttttgtcttgcatgtccttgggagcttgaagctgtaaccatgtggccatgttttcgcttttcacaatggcatcctgtgttcagggttctattcctgcctcaggggatgagtttttttatattcctatgtgtatgtatttacatgtattatgtgtatgtgatgtttatttctaaaagagcattgattaatgggtttaatgagagcttaaatcaaatattttgtcagaaaagtaaaaagtgtagtgccttttagttcacgtgactttaattttccagaaataaggacagttttgaagattattgataaaataaaaatatcttcaaaaatgtaaacatttggcttaaattaggcaggacacatattaagactgctaaatgcttgaaggtcataaactgcttctttaacttttgaaaaatttttaattaacctaccttgaagccattagattctagataagacctggggacatgtggagttagccacgccccctagctatgctggagtcagcctttatctgcacttctgcctggtgtgtccaaggctaggctccacacctagtacataattaaaatcctgaatttagcaacttttcgtgaaaaaccttggtaagagtcaacattataacatgtaattgatactactgaagaaacagttttatatgcaaattgtgtaaagaaagtgaaatgcatttttcattaaaattatatatatatatatatatatatatatatatatatataaagtcatgggaatttagatttttgcctagattaaagcattaaaggatcgtttcaagttaggatgaagctgactgttcaagaaagctgtggaaggcttatgaaaaaaataaccataaaagagattctgtgtgcgaacattggctaaaattaaaggggtgttattcagttattctagaaactgaacattggaataaaagcactattctactctttaacaaaaacttgtaaagggttataaaaggtttataaaaaccttaccttatggtcaacatgattaagattgaatacatttgtctataaggttttactaagaattgggtttgacatcaataatgcatgaatacagcagtgacatttggcttatttaatattacagtcatacaagaagcattatcaaatacaaaatggcatttggtttttttgggctgtatttgtataaatgtgtcattggtacatgttccaaaattattttaaaaaaaacttctttaaccctgatatgacttagtgtatgctattaataattgttaattaaaatcattgcatgccacagagtcaaccacatttttctagtcaattttggctttaattgtggctgttctaagacttttggtcatccagacaattgtctcatattagttctctgtaaaaggtggtttagaattaaatgtaggactctagaaaactgtgcttttaaatgcagattttctgataaatttggacattgtgacatcagaacagaggaaaacctttcaggactcagggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtgggtctttctctgttgtctccgagtgcctcctcttccccaccctgcctcaggcaatgctttcctctttaactttttgtgtaaaatgttgctgatcttttgttttgtgtttcagagtcaaggaaacttttgagctattacagcttttagcaattgagtaaagtatacatgtgtgaacaaaattgagagcatatttttttctctttacttgatttctccagattttggaaactcattgtgaatagtctcaatttatggcaatatagttatttgcatgagtgtaataagaatctgttgggtttttgttttgttttgttttattattattattattattattatttttgataacaagacacaattggagaaactggttattttaccaagactttgatggaatggtatactctaaggaatcaaacttgacttgccaagtcaataaaagccccttggggaactggcctcagacctttgatacaacagtccatgtacatgatttctgacctgtggtaagtaaacaatgtcaccttctaacaggtccaggagccccaagttatcttgggaccccaagaggagaggaatttactcagctcataggtatttgaggatacaaacccatggtagggcgcggcttaaaaagagtcttatccaagattccttctaagaaacaaagttccatcaaaaccagtgttaaaagtctatgtgaaaaataattattcttgctgtactttatataaataatcaggccaagtataataaaacaaattggtcttaccatgacttatctttagtgaaaatggaaaacaggagaaagaatattacgtttcaagacctatgttacacttggtattaaattctagtctcatcagttgttgtttgtttatgcagtttaggctaaccctgcttattcctatgaaccaaccagtgatctttgcctgctactctgaaaaaacaaggcattttggtaatgtaaaaatctggatttcattctaattctgggcatgtactggaattgcctagccacctcatgtcagcttggttccagtagttgcccagttcatgaagagccttctaatttagtttacttgggatacttttgcttattttgttatattgctgttttactctttgtgtaggaatgcagactaagcttactaaatgttttcttaaaccgaatacttattaatctttcagatatcacctttcgtcaggactcaagagttctgaatggccttcatcatactgaagctttctgactgagctcctctttaccctgaacacaagagaccataatagtcaggcagaaatatcattgcccctattcagcctgaagaagttacagaagatgaatctttgtccttctacaaccttaggattaagggttcttttataaaagggaaggaggaaatgtctaagacatatgaactagagcaacttcatcctgaataggagctgagtaaaataaggctgaaacctactgggctgcatcctcagacagttaaggcattctaagtcacaggatgagataagaggtcagcacaagatacaggtccttaaaaccttgctgataaaacaggttgcagaaagaagccggctaaaacccaccaaaaccaatatggccatgggagtgactgctggtcgtcctcactgctacactcccaccagcaccataatagtttacaaatgccatagtaacatcaggatataaccccatatggcctaaaaaggggaggcttaaataatgcaccccttgcttagcatataatcaagaaataaccataaaaataggcaaccagcagccctcagggctgctctgtctttggagtagccattctcttattcctctttcttaataaacttgctttcactttactcagactccccatgaattctttcttgcacaagatccaagaaccctctcttgaagtctgattgggactttttcttgtgacagattctgccagtttctgttcttggcaggttccatttctacaaattcctcatctctacaggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaaggtaaggaggttatgacaaaaaacacagaacgtgaccctttgaacagcaggagagtagaaaccgttcttgtcatcagaaatttcagagaggaagctcactcactgtccagcttccctcccacacaatggaagcataaaaatggaaacccattttgcacaagaaattagcacgttgcccctcaagagaattatatcctatgtttgtttctgtaggagtgtctaaacagttaaaaccatgtaccattcacaaaaatctatacataaaacatgaatgtttagaaagtgaacacatatagaatgatatttgtttcaatttaagatgccaacctggatacaagtacacattcagtttgactaaaattgctgtaataataatctaaaagcaaaactaaagaagggtagaaaaaggaaggtaacagattcctgccattgataatggaaatcatagcatgtaaacaaagccaatcctgcttgggaagttcaccctgagcctgcaaggaatgtggggaggcagcatggggcgcctggatgttacaggtagttagttaggcatgagtggggcaggagagggctcccttccccccaccgcccagaatgtcagacaatctggtattgattcagagattataacgttgcctctctaataataatgcataattcagcagcctgagatagggaggtacaatctcttgctgatccacagctgttaacattaaagtgtcaattgaatgcaggcaccaaggagaagcaaagaaggtttccaataaaatctcaggtattgggcaggtgaacccaggtatgtgcattgagagacaaaagggtggagtacgaccttccagggacactccaacagaaacaggaagaaagcgtcagatgggcatgcatacaacttcctaaacacactgcgcatgctcacttccgaagtgtaaggagggcactgtgcattcgggcagcctatcctaaggggagaataatgagaaaggggcacaagatggccgcctatgaagtcccaggatcaaggttaaatgccgcacttgttcttcaagtcacctgcttggatctcttccaagtgttctttcttttcttccctgttctaaagcctttttaataagcttctactcctgctctaaaacttgtcttggtctctttttctgctctatgaccctcagtggaattttcttctgaggaggcaagaactgaggttgctgcagaccagcaaggattcactgctgataactcaagataccttccaccagtaacttggagatgacaccaagagacaacacaggcaaaggaaagtgtattaattctgttttaggtgtagaaactggagtgattggaaaataattcctaaaagaaattgaaaagtcaaattgtcaagcagtaagttcaccatcacatttaccataaagcatgtagagaaatggaaatatttacacatcatagttgagagtgcaggatttgcagtcagacagtttctggcacttagtagctttagaaagtgacttaagccctctaagccctcagttttcacatctataaaatgaagtaaataatataagcctctcagaagtggggtgagggttgaatgaaacaatatgtgagtagtttaacacagagactggcactgacttaagaaagtattgtgataaaagcagcagtggagaaaatattttgaatagctgtatgcatggcaatcctttaacctctttattcatggcaactcatttaattgccacaacaaatatgtaagtacttttattatttccattgttatggactgagttgtgctaccttcttcatttcatatgttgatgtcctaagtcccagtgccccataatgtgactgactatatttggagatggggtctttacatcgataattaagttaaaattaggtcattagggtgggccctaattcaatatgactggtgtccttatcaggaggttaggacacagacatgcaaagagggaagaccagaaagaaggtatagaaaaaaaaaaattgttatctacaagccaaggagagaggcctcagaagaaaccaactcaacaaattttaaaagatgtattttggagaacaaaactgttagaatatatttagaacagaaaaaaaccatttcttctagaactaagttggtctaaaagtgcatatcttggtaaggctctgtgaggaaatgacctaatctggagagaagctgctgggacactcgtctgtgtgtggcctgtggctcacaggggcaggtattctcagaacgcacatgggataatcaccatcctggtgtgtccaggctctgggaacaggctcttcctcgtggctttcacatgagtttcctggtgggctatgtagtcacttttctgcatccttcttttaaaggctcatgaatgtcaaagtaacacagaccctgagatgaggcaggaaagttgtatcggaatgttttcagactatcaaccagaccaaacgttctggaatccataagatccagggctggggataaatttaatctattaattattcttctgaagttggcagctttgaaaaagatgccctgagtcagcatagtcattctaaccaaaaagaaaaaagggaaaaaataatcatctttcccaacccttaaatcgtccagcactaaccagactctgagaccctctgcagcagcagcctatcagtgcagccacatcctctctgagcggatatgacaaaccccagggttgaagcgacctaacctatgagccgccacacacactcaagatgccccagacaccctgcactccgatcttactcgttcctttactgttttcatcctaattgccctcttacacatttgaccacacatttttggtcttggtggttgtattagttttctgttgctactatacaaattgccacccatttagtggcttaaaacaatgcaaatgtatcaccttacagttccgtagttcagaaaccaacataggtatcacccagccaaaatcaaggtgtcggcagatctgggttcctttctgaaggctccaggggagaatcgattttcttaccttatgggttgttttcctctatcttcaaaggcagcacgttctgttgctctgaccctacttgcatactcacagctccctctaaacactgccgggaaaggctctccacgtttaaggacctgcgtgattacattggacccacctgggtaatccacgaactgcttcctatctcaaggtcggctgattagcagccctaattgcacctgcagctttaattcccatttgccatctaactgaacatccacagctgttacgggttgcagggattattagcacctggacatctttaaggaaccattcagccctccactccgatgttccactagagggcactaacatattcctgtaatataaacattaaaattcagataatggtgggagggaaagtttgataaaattgaatactgtattatcaattttaaaaacttgatatataaatatgtctcattggggtctttcaaaagctaatcatatagtacaagaaaatacataaactggagtgactctcagaactaaaatggcctgagcgtaagtgaaatagaatttgaagtgaggtgagaattctgcagtctattcctgggctcaaaatcacatagaaaaaaacaaaaaaaggttgctttatatttaaagggacaaggcataggttctcttacaggggtttttaggaaatggttcatcagtttagtaggtgttagcttaattgcttttatcgggatactgttgccccggttgggtggatgagcagtccctaaaaagagaaggaagagagcaaagaccgaaaaagtatgaaggagaggaagggatggcatggcgtagaatgaaatgctttttcatcaaaatgcaaagatgaaggagatgtttcagagtgcccggccgtctagagggttctgtttactttccattcccgctgttagggacataggagtctgccctacattagggaaatggaatagaataagtttctagaattcctaaatatggtggaattgggtagaaaagatcagagggaaggttgtaggaaggaagggtgggaaagtaaaacaactggctcctactgtaaggctattggagcctcaggctaacagcatcattttagtaccttggttgaggtagaaaaggaaacgagagcagaatagcctcatagtcaaaggaacacagaaggagaaaccacattgctgaggagagtgaattagctagtagagggacagaatatagaattagctacctcctaaatcttgaattaatctaatatgaaaagacattgggaaaaattataatactctgaagtgtaattatgtacctgttcaactttgaaacaccacggaatgttgggaaatccaatatccactaatagtgagctatgtggacgcgagtaaattctgaaagattttgctatttgggatgtcaaggtttactaagtaacatgaaattatttacttgcagtgggtttttagaatgaaagttgttttccctctcttaagaatacccgaattcacagctaggatatggaggatttgccaggaaaatgcaaacacctgtggctgaagtagagccaagctctctccctacatttttttccagaaagcagtggtgaagaaatagaaaaagagagaatactcctcttagatcagagctaaggtcctgatagcaatcactcctttctcaatgcatggaatggaaactgttagagctgcacctctcaccatgaaggggtctgggggcaaggaactcatctctgaggtttgagagtaggcctgaaaaccgggaagggggccccttcttgtctggagatgataatgatttggcaaaaacaatgacgggctctgtgaggctctacttgtggtaggaagcttttgggaagaaaggggtagcctccttctattccaccatccaggaatacattcgttcctacaaagtacaagaaggattcaaaggtatacatgtgtcaaaaatcacaatgagcactgtaaatatatgcaatttttattcatcaactataccttaattttaaaaattaagaaaagttcaaaggtgttcgaggaggaaggcattctggggaatcctaggaaagtcacctcaatgtaggaagaacatattcaggcagaaaagagagcagtaccagcagctgctggaagatctaagagaagcttgacactcctggccccaaacactgcctggctacaacacgatatccagggacagataccttccatgtacagcaagctgtggagtggcaagaaagcaaagcacgtaccaaaagcaggcaggaagcagagctggctggtaaggctctgaggttactgcaggaagcaggtgttgcctctgcctttcaccagcttcttctggagaagaacagagaaggggaaaagaagaaagatgctccagataccatctttggtggaaacagctgctagctctagcaatgatgactaagtcaattttgctaaagagcaaagaagctgtgtgtcttggattttaaacagcaatagactagcaaaataatctatgatgtgaatctgagattttacaccctagactcttttaaaatgtagtgactaaaaatatataccagtggataaatgaagtcagggatatacttgaaattttttctgccagagtagaaatgacttcaaaatatatgataatgcagctttcatgtaatcccagctactggggaggctgaggcaggagtattgcttaaacccgggaagcggaggttgcagtgagccaagatcatgccactgcactccagcctgggtgacagagtgatactctgtctcaaaaaaaaaaaaaaagataatgcagctttcaatattataagctttatgttctcacacttctaagtgataatcaaatgtgttacaccactttataccctgagatccaaaatacataaatatttgacagtttgtacaagactgtattaataagaaaatgtggcacatgtataaagaaaggaatctcacagattaaggaaaatgacattgattacaaatgtcctcagcctgagttggctgtgttgcgtttgtacacttcagccctctgagctgaagtgggagtggtttctctcctgaaaatgtttctgaggcccaaatagctgaagaggtggagacgttacagaaaccacctggagcccccagaactggcagacacctgcctgatgctgccatgggcccccagctccttggctatgtggtcctttgccttctaggagcaggtgagtcccagaacacataggcaacttttggccttattttgtaggcctcagcccaaggcatctcctaaaggcttaagcattggagatccccttcagcgctgcctctaactctgtccccttcctttacaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagttaggtctagtgccagggtacactctcccatcctttcttcttgtggagcttaaatctttaaattcaactaaactgttgcccaaactgaagactccatttacaatctaatgggtctcaacaatatttggttctgtattccaggtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctcttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcaggtatgacgtccttgaacttggtttgctagaccctacattaagcctttttctggtggttacacatcagtatatttcctaagttctctctttttagccacaatgtccatgaatgctggtgtcactgaaatttcagtttatcaagtttcagagtcagaatataaagttctatattacaaccagaatatgttttatgaccaatatgtgctgagccagacaagaggcaggaatgaagctccaactaatctatttctcagttggtgcttggagtacaaacaaatagagagtctctaatagacctgtgtctcttgagataagactgagcatttcttttttttaatatatatatactttaagttctatttcttgcaacctccagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagtcaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtactaaagataacaatgtttatggttgtgaagctttttttgtaagcaaatagtctggtgaaactgaagttcaaaggtgtttgtgttgggtagctgtgtcagtatgcttgatttatggtaaggccaagtctgttggattagatattagatattcacagtaatgtcaaaactaaggaatatagtctgaataattacaataactattttatattattgcaaacaacttaaaaactattgtgacttgattgattcatactatgcatggatacagtttcaaaacctgtttagaccatcagaaagttttaatgaataatgttagcaaaataaccacaagtaaagtgttaccggaaaatgcagtataagcatcacactgacagttgtagctgacccttttgttttgatcagtggttctcgatgtgtaccaaaattacttggtgagatttctttttattgtgggaataacacttagcatgaaatctaacctttaaacaaaactaatgtgcaatatgatattgttaactctaggtacaatgttgcatagcagatttctagaatgtaattatcttgtataattgaaactttacaccaattgaatggcagctcagttcttccttctcccattttcctggcaattatcattctgttctctgcttctctgtgtttgacataatgctaagtgaaatgagccagtcacacaaggacaaatctttcattgaaggagtcttttatcaccaaaagtatttagaattcctggcacttggtgataataaaagcaaaaccatttcacttgggttttatgattgttttaaaatgctttgcaccctttatcgcttgcacctggggctgaacacacctaccaccccattattgatataccaccatctccccaaccccatcaggtaaacctacacatgtgagcactcacatgaacctacacatgtggatttgaaccagattcaaacccaggcagcatagttccaaagcctgccctattacccaatatgctacttgtagtaattattaagtatattgtatgagaaactaagactgctctcaataaaatatatgttgagagtgaggagagacagacagagagagagagagagagagaaaatggtaaggttttcctaatcacagttggtcaggaaaaaaattaccttcactttcaaagactgagactcaccagaaggactcatgggactcggcgtgtccttgtactcatagcaaagatgtatcacaaatatgtagtaagaatactatgatcacaaggaacaaagacatggtggactttggagaaatccatgtgagacttccttatgttctcttccatgagagagcacactctcaccccaacaatgaaaatgcagcaacgtgagaacaacctttctgcccagggaagctcattagagactcagcacctccaatactttcagtggctggtgttaggtgctgaatcgtgtcattaaacattcatatgttgaaatcccagcctccagtactaagaatatgactatgtttggagataaggattttacagaggtggttaaggttaaatgaggtcctcactaatatgactgggatccttataagaagaaattaggacacaaacatgcatagagggaagacaatgtgcagacacagggggaagccatctacaagccaaggagcgaggctccacgagaaaccaaccatgctgacaccccgatcttggatgtctagtctccagatgtatgagaaaatacatttctgttgcttaaatgacctagtctgtggtgacttatggcagccctcgcaaaataattcagctgatcacattggcaccctctgcctatcatgcagcataattccagacttgacgtaaagcaagtgttcagcctaacccacgtggtttgtgcaagcagtctagacacactaagccatgcttaccagttactatagtgggaacactcccaaaattcaagttcgcagatgcaaatcaagagccaaccatgcaagcagtcccttctaaggccagcagtctcaggcccgctgtgtcaactcttttctatacgtgcacatacacacagtgacacttccatgagcacaagggatgtccttcactctctagcacctctagaccctttctagtctagacaatggctgagggattatgagagtgggccgggacaatgacatcacagaccatcaacccactgcctggtcctgggagaagacctattctttcttcaaagcagccatgggaatcaggctcctctgtcgtgtggccttttgtttcctggctgtaggtgagtcctgggagttgctgggtctggggagttggtggcaacccctgtcctactattttgaggtcttttataccaagctcttttctcctctcctccttgatggcctgtttttcacccttgctttctgtctctcacaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctctgcacaaaaagagcggacgtaagagagaaggggccctaactcagggctggtgctggctccgatggcacattcgtgctaaatagaaaaaaagcggccactaaggagaaactagctccataagcacacttctttgcaaggagagaatgaggtattatttttcacccctttacaagtcagggactgttctggatttaattcccccagtccgatgtgttgtaaattcacaagtcccaacaaggaggaaaagtcctctcgcatattcacagtgtaaccctgttctaccatttcgttaatcaattttaccttcccttttctatcctcgtctctcttaactgtgcattttctactttgcttagtgttttgctcttggttgacatttcactagaggacattaacatattctaaattctttcgatgatttttactgtgcctgtgctgattcaagagaaagtttgtggaatttgaattttgttcattcaatttagaaagagaaaaactctgattaaaacaaattcttccaggttctccgatcaatcatattttgctggaaaaaattctgatcacagaaggtttaaactctgctgcagaaggtggtaggaatttggttataactgaactcacaatcttctggaaaaagtgtgtatttgtctgtctttaagaataaaacatatgctcttctgtcagtaaaaattaacagtgctttggaaatacaaataaatgtaaagggtattagaaatcccaaactgcagagcacttgcacaattattattggcaagacaaaacaggcatctgaaaacgtattttgattcagtgctaaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggtgcttgcggctgcagcgtttcccctgagataacacacaaggtttgatacaagaaattctttctccaccttctaaacattacagtgcttaactcctacatcctgttcaagaaggagaattctgagcacacggtttgccatagaaacttcagactgacattgattaaaaggatgctgaaaaagcatcgtgagccagggcagcaacgtctctggggtcgtccacgctctgatgatgtcacacctcttggcccacctggaagacattttcccaacagcattaccaccatcaaagaaacaaaacccaactggtcactgcacttttgctgctcacacaatgacgaggatggcaagatctatagagaacggcaatatttttgtgcggaatgtgatgtttcactttctgttgttccgtgctttgaaattttcccacacgaaaaaattatctaatagtgattattatatacatttctgtgatgttaggattagaggccagttctgtttagaaataattccaagaacagtttttatattttattttcatgttgataatcagtcaaatttgcttcagcctcaaagagcatgtttatgtcaaattaaatgaatgctggcagcgagctgcactttttttactaaacaggaaaagggttaaataacagaacactgtatctacagattttcatattcagtgaaacttcaggttttctgagagtcctacattttcccacagattatttatttcttatagcaagtattgcccagactcagaagatcaactgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaaaaaatgaaaatgaaaataggcagagatggagtatcaaacatcaaagtgagtaacagaagacatctaaagaggtcaaaaggattgtagattgggataggaggtttgaatttagaaaaaaaatgaaaaagtgttcacgggggagttcacagtttacagaatagactttttttttcttcttcttttgaaatggagtctcgctctgttgctgaggctggagtgcagtggcacaatcttggctaattgcaacctacacctcccaggttcaagtgattctcctgcctcagcctcccgaatagctgggattacaggcgcacgccaccatgcctggctaatttttgttatttttagcagaaatgagttttcattatgttggtcaggccggtctcgaacgcctgacctcttgatctgcccaccttggcctcacaaagtgctgggattacaggtataagctaccacgcctgacccacataatagacttttaaaggcacataatagatcatggatgtttaccatgagggtacagagaataattcagaaaatgtaaaccattatttcactaaacatacataaacatacatcacattaggagaccaacaaattcacagaacataaaaattgatactctaaatctccaagtaagcaatgtttgtttatctatttatttatttatttatttattttgttttactttaagttcagggatagatgtgcagaatgtgcaggtttgttacataggtatacatgtgccatggtggtttgctgcatctatcaacctgtcatctaggttttaagccctataagcattagctgtttgtcctgatgctctccctcccctcgcccccgacccccaacaggccctagtgtgtgttgtttccctccctgtgtccacatgttatcactgttaaactcccatttatgagtgagaacatgcggtatttggttttctgctcccatgttagtttgctgaggataatggcttccagcttcatccatgtccctggaaaggacatgatctcattcctttttatggctgcatagtattccatggggtatacatgccacattttcttcatccagtctatcattgataggcatttgggttggttctatgtcttttaagcaatgttttaaattatgtgatttgggaaaatataacaaaataaattattttttgttgaatgggagtattaacagggctctttgatgggacatggctgggaagatgtctggcctcttcctgcagggaacaaggaaaatttagagaaggaggcaatttttttttctctagagtccactgagatatcacaggtagtttatacatataaaatacagcagccctgacatacagatattattttctcctaattaaaaataaatttaaataagtgaagtgtaattaaacctaaatttaaatgacttgcctataacctcacagctgaaaagttagtggaaaggcatgtttctatattgttttttaaataataagataattgaatccaagataggtatatttccatcttcagctgaatgggtcccaagaccaaccattaggtgaaagacgtaatccacacagccagggaattctaccttctacctttgtaacagcaagatagccatagcaccaaagacatttttaatgtcttagcacaagcttctaacacctccattttgaagtagaaggatgaaggcttgagagcagaaactggatcttgttagtgatggacaagtggacatagtcatattaattgtgcgttttacaagattctttgataatcactattaaaccagctgtagatacactgtatcatcatttatctcccatgtcaccatcatatcataagattaacattgatgactttgaaaatttgctgctaaaattaaattatctcaattttccagtatcctcctaactgacctagccaattttgtatggcttgaaaaattgggaagtcttctcatctgtgctagatcttcttcaattaatttcaattcattaaaacagaaatagcaagaaactaagagtcaatggggtttcttcatcccatcattccctataaagggcagtgacaagcacctagatgtaacatagatttcttctgccctctgttgagggcatcagaactggctcagttcactcagacatcggtggcagaaagttgagggagatttcctttatgcttaagccttcagtagaataaactggtacctgttctatccaatggatgctgtcttatttaacttgggacactgaaggggtactattcactaatgaaaacattaaaaagcagaccataagatattttaaagaaagagaaaacataatgaaggatgtataatcattacatagtgtatcagtctgttttcacactgatgataaagacatacccgagactgggaagaaaaagaggtttaattggacctaagagttccacatggctggggagggttcagaatcatggcaggaggtgaaaggcacttcttacatggtggcagcaagagaaaaatcagaaagaagcaaaagcagaaacccctgagaaacccatcatatctcgcgagacttattcactatcatgagaatagctcaggaaagactggcccccatgattcaattacctccccctgggtccctcccacaacacatggaattctgggagatacaattcaagtagagatttgggtggatacacagccaaaccatatccttctgcctcagtcccctccaaatctgatgtcctcacatttcaaaaccaatcatgccttcccaacagtcccccaaagtcttaattcgtttcagcaattacccaaaagtccacagtccaaagtctcatctgagacaaggcaaatcccttccacctatgagcctgcaaaataagctagttacttcctagacacaatggggatacagggattagataaatacagccattccaaatgggagaaattggccaaaacaaaggggttacaagtccccatgaaagtctgaaatccagtggggcagccaaattttgaagctccaaaacgatctcctttgactccaggtctgacatccaggtcatgctggggcaaggggtgggttcccatggtcttgggcagctccactcctgtggctttgcagagtacagtctccctcccggctgctttcacaggctggcattgagtgcatgtggcttttccaagtacacagcacaagttgttggtggatctaccattctggggtctggaggacggtggccctcttctcacagctccactaggccgtacccaggtagggaatttgtgtgggggctccaaacccacatttcccttctgtgctgccctagcagaggttctccatgagagccccacccctgcagcaaattttgcctgggcatccaggccttctcatacatcttctaaaatctaggtggaggttcccaaacctcaattcttgacttctgtgcacctacaggctcaacaccacataaaaggtgccaaggcctccaccctctgaagacacaacctgagctctatgttggcccctttcatctatggctggagtggctgggacacaggacaccaagtccctaggctgcacatggcatggggaccctgggcctggcccattaaaccagtttttcatcctggacctccaggcctgtaatgggaggggctgccatgaaggtctctgacacggcctggagacattttcccatggttttggggattaacattaggcttcttgtgcaaatttctacagctgtcttgaatttctcctcagaaaatggttttttttccactgcattgtcaggctacgaattttataaacttttatgttctgtttcctttttaaaatggaatgcttttaatagcacccgagtcaccttttgaacactttgctgcttagaaatttcttctgccagatacgctaaatcatctctctcaagttcaaagttccataaatctctagggtggggagaaaatgccatctgtctcttttctaaaacataacaagagtcacctttgctccagttcccaacaatttcctcatctccatctgaaaccacctcagcctggaccttattgttcatatcactatcagcatttttgtcaaaggcattcaacaagtctctaggaagttccaagctttcccacattttcctgtcttcttctgagtcctccaaactgttccaatctctgcctgttacccacttgcaaagttgctttcacattttcgggtatcttttcagcaacaccccactctactgataccaattttctgtattagtccattttcatgctgctgataaagacatacctgtgactgggaagaaaaagtttaattggacttacagttccacagggctgcggaggcctcagaatcatggcgggaggcaaaaggcacttcttacatggtggtggcaagagaaaaaagagaaagaagcaaaagtggaaacccctgataaaaccatcggatcttatgagacttactatcataggaatagcacaggaaagaccggcccccatgattcaattacctccctgtgggtccctcccacagtgcatgggaattctaggagatacaattcaaacagagatttggatggggacacagctaaaccatatcacatagtatatattgaaaatgtattgtcaagtatcttggatgagatacacattgccagataccatacagttacctgcctaagaaaataagccaataattatagtctattaatggtaacattagacagacaaatgcttacatggtaatgccagagcccatggtttgagatgctctgacatgtgatgggtctcatacatcactttcttgtctaaaaatagtagctaagtgttctgaaaccttgccctcaatgaactcatatttcttaattattgccattctgctttacaaatgctcaaaaatctgcatatttaatattcagttatgaatatattttatgcatgtgtagggtggcaggataagaagagggatgatgttaaatttactaacttataatttctaggtgtagaactattgcttgcccatatctgaatattaaagctatatttgtccttctttgaattttgattatactgtctcttccattttatttattaaaaattatgaccagagagagtgtgtgtagttgatacccaaagcagaaaatcaagttatagatgactagtttataaattaaacagaaatcccttactctcacccttcacagaccatctaagcaatacatcaaatgctagtagccaacattcttctttttgacaggaaactagaagtttattctaagaaactaaataagaagatctcaagccttggaattacatggcatatcaagagtgatatgagatgcagggctaaagacaaagagaataattgatatataaatatatagtctcatatagtcaattatccagtttctcttgttgagaactgttaatgatatgagattttaccatacttgcaagctaagagcttgacaacattccatggatgctagcagaagacaagagactgctggattacagacaaagtatttttaatactctcaacacagcaggcagcatgagcttcatatgtctataagtgacctgtgcctgcccctctgcccagttccccaacagtgacacagagcagtttctggatgctgtggcttttcccaaacctcatcaatctttgtctcatgggggtacattgtgtttattatcctggatagcaaacagatccagagggagatgttgtctctgtcttccaggttgattgctatacaaacattcttgacaagatagtccaaatgaaaagttgatataagttgtgcagaaatgtcagagacccatgaagaattaactctcaacacctctccactgcctttggcacagaacaagtaggtaactatacccacagtagcataataatatatttttatttgaagaaattgagcagcccctgaaaagagacttacaaatactgatatttcagtgtcccttacgaaacaaccagttccccgccaaatctcttcaagtaaaatctcctagcaaacaagtaccatccatattaccaggctttcagtcaggtttttagtgctttactcttaaaaatcaatatacaatcaaagatcactagtatacaaagtttctaacatagatagaaaggaaaaggatacagacattaaaagaaagaagagaaaaagaaaataaaaaacaagaaacagaaaaaggaaatgaaattaaataaatagtgggaacaaagaaaattgactcaagcatataaaataaagaaaaaaagtggacttctaagtagtaatcatgtaaattcttgtttctatcccagacagatataagaaacacatcgtccttaaaacagaataagataaaggggagaaactttaagaaagtcaaaataaatttttaaaataagagtcaaaagaaaactcgatataacatcccagaaaatagaacaaaaagttcaagaagttaaataacagaaaacatgaaagaaaatataagtgacttgaagggtgaacaaaggagagtcaactgtccaagagaaactccagaaaaaagaaaaaaaaaatttttaattatcagagaaattataccctaaaaattagttcccagaaatgaaaaaaaattagcctccatattttaaaatgcctgctgttggctaattaatgtcagacaactgaaatgaaggcatatcttcatgatttcagaacactggggattaaatgattctaaaccacaaaaagacaaagaaaatgttaaaaatcaaaattatacttagagaaaagtgataaataaatgcaaaagtggaatgacatcacatttctacacagcaacgctgaattccagaaaaaaaggtgcaagaaatatcaataaaattctgatagaaaatcattttaatcttagatttctctactaacccaatatatcaataaaatgcaaataaaaagacatttttaataatgttaggatccaaaacatttacctccatctcaagctttcttaggaaattactggctagtatgtctcagcaaactgagaaaacaaaccaaaaagaaaaaaaaaatggggtccaggaaatagaaattctcattcagaataataagaaagaaaagtgccaggataaaagctgggcagtggaactaattagcaactagcccagactaaagcagagggactccagggttgcattttcaaatagtgccaaaacgtagactatggatctattaaatgatacatctgagtaactcatccacaattttgtagtatcagtttgcatggcctgtcaaaaatccagatccatcctggagaaggtgatcccattaaaaagaatccagattattcagcaatatcaaatataggtagaaaccaaaagacaaaaatctgctgatttttcaaaccattaaaaagattgatgcagttctggtaatggcatcataattcttataagacccacgctcccacaaataacaaatataaactcaggacgaacatttttaaagcctatcttaagggacagcaaagcaaccaatagccagtagaaactacagggaagtcaacacttggatgacaggtaagttttctgtttttgtagctttttgctggaaagtagttcccagtcaaatagaaacccattaaaaagccagctgtagagttaggaaagacatccaagaagggaaagtccaaaaaagaacaacccaatgttctccatacaaactctgtttgaatctctggttgatgcctaaactatgcatgtgagaggaatactggaatcagcagtgttaaacctaacataactggatagagatttcagctgttgccggctataggaaacagaatttgaagtataaatccaaccaagttaaatgcctgttaaaacaaaaatccaaccatcgttagaaggataaaacaaaatctagatatattgttgacaatgtccaagatacaacgcaaaaattaccaggcatatgaagaaaagaaatcacatgacctaatttgaatgaagaggccattagtggatacaaactttgagtttacctggatgctggaattactagactgaaatttaaagtagctattataatcatgtttaaggatataaaagaaaatgttcttataatgaataaaataggaacgtttataacaataatgaaacctattaaaaataaatgaaaaatttaaaatttaaactgcaatatttgaaaattaaataaaatctcactaaacgaaatctctagcagattagagatgacggaagaaagattcagaaacttgatgttatatccatagaaattacaaaatctagaaaacaggagaaaaaatatgaaaaaatagcctcagtgatctttagaaaaatatcaaaaggtacaaaatgtgtgaaattggagtaaaagtgaaagaagaggagatataaaaaagcatggataaaaaacaatatttttttaaaaaagcctaattaaaaagtatattgaaagacataaaaagaatttcagaaaaataatttgtagaacacctacctaggcacatcacagtcaaattgtccaaaactagaaaagaagacaaaatcttcaaacagccagagaaaaatcatacataccaggaacaatgacatgaataatgataatttttcattttaaaaaagtgaataccagaagagaagggaactgtagctttaaagtgctacaagaaatataaaaagtcaacccagaatttgatataaaatattcagctaaaaattaaaatactacagtaaagttatctgaatataaataaaaattaaaatatccattgacagtagaactacatgatagtaaatcgcaatggaattctcttaggtaaaaaagaaataataccagttggaagcttggattgtgaggaagaaatgaagagcacaagaagtagtgaaatgcagtcagatattaaagagtcttaaaaattctatatcatatgtaagactagctaaagtaaaaatttcatcattgtattataggatatataaaatatatataatacagaatgacactaaaatctaaaggatggaaataggaaaaacagatctattagatacaaatttcttatattttaagtaaacttctacaatatagtaagtagacaaatagttttaaatgtatcattctttattttccagaatagccctgaaaatattagaggtatagcaaaaagccaacaaataaaaatcaaaacagaatctaaaaatattattcaaatatttaaatagagtcaattctaggagaaagtttggtataatattaaaaaatcaatcaatgtaattcatcttgttaacacatttttaaaaatctatttgattatacgtacagatagaaaaaacttggtaaaattccaaactcatttataataaaaacactcagaaaattaggtaaaaaagggacttcttcaatctaacaaaggcacctgaaaaaaaccaacagcttatgtcacacttaatgacagaaatattaaacgtcttcccatttttatttcttaaatattaaacatgttcaagatcataaacaagtcaataatgttcacccttaccacttctattccatattgtactgatgcataaagacaagaaaaatactaaaaagctaggtatcaaaagataaagaaaacctttttcagagatgaaaggactacttacatgcaaatattaaaagaaatctatatattaactactcaaattagtaagttcatacattaatttattattacaacatataaaaattatattttgtatactaatgataaacaattggataattgaattttaaaacctgaatttatattaaaaaacataaaatatttaaatttagcaaaagacatgcaagacttgtgtacagaaaactaaaaacagttgctaaaggaaatgaaagacagttttaaaatatagaaatagaaataatgtcctgttgcagcctctgcctcaggagtcccctgcagcctggaacacctagcaaaagaaatgcaggtgcagtgccagggattggagctggatccccacaagtcctagaagcaaaccttgtgagggggccatctgtctccccgacccacctcagagcatgcctgtgaacaagaaagtacgagagccacacaagctgggtgttagcctagctaccggccgttactcttaagcgcatctactggatcacagcacaaactacaacactaaaattaccgtgctaatatatgcaggatgtgaaaccaggtgcaagaattcacccacatatgcggattctgtacagagccctggccctccgaaagcatccagaaatgaagccaactgaccacactcagcttacaccacagttaagggaacaccaaccctaccagatgagaaagaatcagcacaagaactctggcaattcaaaaaaaccacagcatctccttacatccaaatgggtcactagctccctagaaatggttcttaaccggtctgaaatggctgaaatgacaaacacaaaattcagaatctggatagaaaggaagctcattgagattcagaagaaagttgaaactcaatccaaggaatccaagtaacccagtaaaatgatccaagaactgaaagatgaaatagccattttgagaaagaatcaaaataaacttctagagctcaaaaatttactacaagaatttaataatgcaataagaagtattaacagcagaatacaccaagctgaggaaagaatctcagagcttgaagaccagttctttgaatcaacttagatgaaaataaagaaaaaagaattttaaaaaatgaacaaaactggccaggcacggtggctcacacctgtaatcccagccctttgggaggccaaggctggtggatcacgagttcgggagatcgagaccatcctggctaacacggtgaaaccccgtctctattaagaatataaaaaaattagctgggcatggtggcgggcacctatagtcccagctactcaggaggctgaggcaggagaatggcatgaacctgggaggcggagcttgcagtgagccgagatagtgccactgcactccagcctgggtgacagagcgagactccatctcaaaaaaaaaaaaaaaataaggaaataagaaatatagggttatgtaaagataccaaatctatgcctcatcggcattcccaaaataggagaaagagtaagcaatttcaaaaatatatttgaaaaatatatttttcaaaaatataaataatgcctaatataaatataaataatgccaaaaatcgcctaatcttgctagagaggttgaaattcaattccaagaaatacagagaaccctggctagttactatatgagacaactatccccaagacacatagtcatcagattcaccaaggtcaaggtaaaataaaaaaaattctaaaggcagctagagtgaagggtcaagtcacatacagaggaaaccccatcaggctagccacagacttctcagcagaaaacttataagccagaagagattgggagactattttcagcatcctgaaaaaaattcaactaaaaatgttatatcctgccaaactaagcttcataaatgaaggagaaataaaatccttcttagacaagcaaatctgaggaaatttgttttaagtagaccatccttacaaaaggtccttaaggtagtgctaaatatggaatctaaagaacctgctgccataaaacacttgaatgcatagcccacaggcaccacaaagcaactacgctatcaaatttacataacaaccagctaacaacatgggtatgagatcaaaatcacacacatcaatactaatcttgaatataaatgggctaaacatctgcttaaaagacattgagtggcaaactagataaaaacacaagacccagccatcattgccttcaagagacccatctcacatgtaacaacacccacaggctcaaaacaaagagaggggaaaatatctatcatgcaaatgaaaaacaaaaaaggacaggagttgctattcttatatcagataaaacaaacattaaacaatgaagggcattactataatgataaagagtacaatccaacaagaagaactaacaatgctaaatatatatgcatccaacattagaacacccatatccataaaacaagctcttcttggcctatgtaaagatttaaacaaccaaacaataatagtaggaaacttcaacaccctactgacagtgttagacagatcactgggcagaaaactaacaaagaaatgctgggcttaaactcaacatttaaccagttgaaactaatagacaaatacagaacactccacccaaaaggaatgcttatacactgttggtggaaacgtaaattagttcaggcactgaggaaagcagttggagatttctcaaataatttaaaacagagctaccattccacctagcaatcccattattgaagatatatccaaaggaaactagatcattataccaaaatgcactcatatgttcatcaccatgcaattcacaatagcaaagacatggaatcaaccgaggttcccatcaacgatggattggatgaagaaaacatatacaccatggaataccacacaggcctaaaaaagaatgaaatcaagttgtttgcagcaacataaatagagctgaaggccgtagtcctaagtaaattaatgcaggaacagaaaaccaaatactacatgttctcacttacaagtgggaactaaacattgagcgcacatgaacacaaacatgggaatgattgacactgagcactactcaaggggaagagagagggaggttgacacgggttgaaaaactacctattgggtactatgttcactatctgggtgcagtatacccgtgtaacaaaccttcatatgtaccccctgtatctaaaataaaagtgagaattttaaaaagactaaatatgttaaaaccagtactctctaaattttatctacagtcattaaaatctcaattgttatctcaactgtttttgttttctaagaaactgagaagctgattctagaaggtatatgaacacacaaagaatttatgggaagtcccgctcctggttagaagcctatgtatgatgtttcaggccatagataattaattacaaaggctttacctggctggtttacagggtgtggagaggctgttctgcccaccccagacttggtgcacagccaatgcattgcagtctttgaagggagttgcagtcaaggaccccctggctggtcacgcccttgtgcatatttatattgccagctcaggatccttcattcttaggtctctttttctgaggcctatgtagaggtcttcttcaggtgcctctgtcaaggcctcctaataggagaggaagagagagccttaaagacacttttctccactctgagtacccagtgagtttccactttctccttgcagggctccccaacagtgagacaactccatgtctgtgctaatccaactaacacttgaccagtgccatttccacagggaaaaacagaacagggggagtcagtaatttctctggctttagactcttgcttacactattgaaggaggtaattaaagatttaactctttcctttggggcttgttgctttaattggctcactacctggatgcaatatacccatgtaacaaacctgcatgtgtaccccctgtatctaaataaaagttgaaattttaaaaagaataaatatgttaaaatgagtacctaagtcctcagcactctttttcagctatgctgagctcctgacactctagaatattcaaaacaatatttagaaagaacacatttggagtcctttcactgtctgaccaagacttactataaacccacaataatcaaagtaatgtggtactggcaaaagggcagacaaataaaagatacacattaaaaccacaatgagatactgctaaccatccacatacccactcaagttaaaccacctggcaacaccaaatgctggcaaaaatttggagtcccagaactcacatatattgttgatgaaagtggataatagtacaaccaatgtggaaaatgttctaatagtttcttataaaactaaacccctctgatcatctacccctatgagccagcaattatactcctaagtatttacttaagagaaataaaggcataaatctacaaaaaaagacttaaactggaatgtttacagaaagtgaattcatcattgccaaaacctggagatatcttgaacgtccatctacaggaggctggctaaacaaacggtagtatatctatatggttacatattccactgccacaaaaaggaatgaagtactgatacacacaacttgaacaaatcttaaaaatattattctgggtgaaagaagtaaacaaatcttaaaaccattattctgggtgaaagaaactttgcacagaagagcgtatgatgttattccatttatataaaattctagaaaagaataatttataatgaaaaaatcagaacactaattgcctctaaggagttagcagtgggaaaaactaaaggcatgagaaaactttggagataatggtaatattctacaatttggtaggttacacagtgtatgcatttgtcaaaacttgtttaacggtattcaagatttgtgtgtggtgctgtatgcaaattttacctgaaaaacaccttgaactccagttaattatacacgtgctgaactgcttagaagtgaagtatgcctccaactgacttttcaatgaattaaaaaattagatggattgatggatgaatagaaggatggatagatggatagttatgtggtaaagcagtaacagttttatccagaacctaggcggtgggtacatgcatgttcactgtataatagtttcagcttctatagatgtttgaaaattctcataataaaatggaaaataatggcatgattctgtgtattttttaataaaatcaactttgaaatatgctgataagaaccacattgctaattaaagaagtgaagtacaggaaggtttgggctgtgtgtttctgtgtaaaagaaggaggagtcagatttacataaacttgaacaagcaagaactattatttctaagaacatgtagcaaaataattacaagactgtctctggagaaggaacttaccttttgttctctgttataattgaatcattaaccaggtgcatgtattaattcaataaataaacacattaaaattcaatgagagtttagtatccataacattccccgagagaaaaatctagagaccactgcagtttgaaaagcatgaaaagggagaggaatatgtttgctgttttttgttttttgttttccaaacaaagagaatactgatgaagaagcaaagatttggaatttagtaaagaatagggatcatttgttaattttcagaagcttttaggataaataaaatgaaaaagatgctgggttattttggcatagagtttgatacacttgactaaaagatttaaaaatatacctacatgtcaagaaaaactgaagtattctataccttttactacttctacttagcagagtttatcttgagccactgtccgtggcatgtccaataagttgtaaaggcttcacacacactcctcatatgaacaagttgctgaaatattgttaaagtgtcacattttgtccattataaggtaaattgtttttcacaattctattttctttgaaatacgggtaagtcctataatcaatcttcacctttaatgtggtagtactaaacaccacccaaaagtaacaattagatatttaatagaacatcttataatagagagaatctcagaatcaaataaataagatgggttagtttttgcaagcctgtctttctggagtttcctagtattctttagagtgttaggcctatcattctcagttacccaccagactgtactttactaaggcacaggcaactgcaagagtcagacaatacttgatagtgttgatattgacacttgagatttgtgatcgcataggcattgatttgagtcctgactctgttacttactcttggattatatgaacttggataggttatttaaggtctctaggtcttatctgtaaaatttcctaatccgtaaaaatagtgtgatgataataaatagcctagccaaaaaaatagacttaaataaatgtatgaaaagtagagtaagtgctcaaaaacttagctctgcttttatgcaaaaatgaactattttaagcagttacatgatacgagaaatcagcttgataatggaaaaagatcataccattgtggtcaagttttacacaaacatgatctgtttcgtggcctagactgagttgaattagaatagaagaaaccatattacaagtattcaggaattaagcaaagacaaaaaaaaatagttatgactgtgataactgaaacaagggaagagatataagagacaatgcatttaatttgtgaattgacaaataaggtaggtgaggaaaaaagaggcttatggaattcttgaacctaacatgcaagaagagcagggatgccatttgttgggagaggggaattgaggaataagagcccgtttattggtgtgtgtacgtgttgggggaggaaggagttcagtttgggacaaccatgaagacccagcagacagctgaaatactgtaatgaagttcccttatattctaacatattacttttagttctttgaagtcaattctgcaccccactttttgctctacacccagacagtagcacagattggtgttcagtaatgacagatggaaaagtgatgggagaatggtggtgagtggctggtgcatgctgtgagacttgtgcatgaagactcatcctgagtgaagagccacacggttccaccagggggaagactgatttttgcatatcatgcagaaactcaaccacctgttagaggagggaaacagagtgggaaggaactacgctgtaggaaggaaagatgaacttgagtttcacttcttagtgccttttctcaggggagaggccatcacttgaagatgctgagtcttctgctccttctcctgggactaggtatgagccttgtcttttgaggagtctggggttaatgttaacactgggtggaaagactttctctccagagagtctgaagccaccagacagaagatgaaggggatatgttagattaaagaaccataacagagtaattgttggcacaataaaaaggaggcagttccctggggtcctttgggagctgaggtggtattggagagataaagcagagaccttcctgcctggggagatgtctgaccccaagcttgtcggtcctcatgaatatctctctggaactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaagacacagtgcggggcacagatcaaagatctgagcaagaacctcagctctctcctacccagctcctctcacacgagcctgaaggccctgccaaggtgggacagaaggaggaaaccacagcttttgggcagacacagctgtttctgtgtttgtgggtgggcatgggtatgaatggatagactggggatgaggagagcatctgtaggactagctggagcgttctatccacaggcaggaagagtggctcctggaaagctgagggtaaaatttcttctagaagggtgctcagaaatacccaataaaaacaatcagatacagtttccttcaagtggcggggtcagtaatagcctttaactgttttatctcaaggctctttttagctggttttctatcataatatattttggaagaactttagtcatcttgaaacaaagctggtacattatattaatgacatctggttgttctcagtgaataggaatgataaagccctctagatgcttcaatatgacaatatgacacatgcatcccaggccaatataaaatctgcaaagttcaggaactttctatactggtgagttttggagtggtccagatgtaagaagtaagctgctgcaccttagatcatgtaccacggagaaagaggtgcaatgcttagtctttggactttgaattaaactttggatatactgcatttgattgtgctactctatcccatttactatgtaatctgtaaagctggggccagtgcaagagagggttctgtggcagaagaagcccatgatgaaagcttcctgctgcttgggccatggactaagcagacccagttgttcttgaagagcctatggtagatactgatgccctgtggagctcctgacattccccaatacgagaatcacaaggcagtgtggaacaggtttgctgtgccctgatttgcacttcagaccattgcatcttgggctatacttttgttgctttccagatcccagagagaaagaatgctcacacacacaaattacatgaggagtgtttattacttacatacaggcagcaagggaaaacagaggcctaagattcagggaaagccagtcccactaggctcaggaaagctgcccagggtggatgaaatcttgtctgtgccttccctacttgcactgccactgagggacctcagagagcagccaccctgggttttatatcttagagcaacttgacatgcttggcaaagcattgaaggacattctatttctagaagggactggaacagagccctggctgttctggccagttcctccttatctcaggatgttacagtcccagaacattgtacagttatttttgagaactacaagcaagaaataggggagtactgagtttgtccaaggccacctggagaattgccctgcagacaggtgcagagttttggtgtaaagccatactcttaccggccaacgatcccctttcttttgaaaagttgctcctggctctataatggatgcctcataatggcattcagaacaaggtattatctgatctgcaaaactgtaaatttggctgtgcccagagcattctgttattaaatggaaaatacataatcaagaccatacttaagcacagctggaaaaaggcacgattcaatttcaagagcacatctcagagtctcatgctacccactcatacttttctcctcttaccttcaaaccacacccaagtttcatggaaattccatatttccagttgagaaacatgagcttatttttttgatgggtcttcacattattctggaaggatcattacagtctaaccaagtatggttctgaaaggtagtggtgaagggaaatcttctcggggccaaaacttaaattggtatacctgattgttgtccacattttattgaagaagagatggccagaagtatagctatatcttatgttcaattttctttcatactatcatctagtctccttacctattcagtcatatttttcttctttttgcttctctatgctacaatctgggtaatttctttaaaactactgtttagtttactaattcacacctcagctccagtaagcctctaatttaatctttcaactgactttgttcatctaaattatattaatttttatttctagaaaatccacttgggtcatttacaaatatgagtggacatttttgaaagcatcttgttccttgtgtattttaaaattattttctttttataagtatattaagcatctactgggaattattatctgacaatgccagcatttgatgcctttttgcatctggctttcagtggtctgctggctctcactcagggtagcctatttccttgtacattatgtaagttaatgtgaattcatctttcagaattctttaaatactggagtaaaagtgggttttctaggaaaattcatgtttgcctctgtcaagaaattggggcgctacagacctaatatcattttattttataattctcagtatatatcttcttggtcatagaatgtctatctcaaaccccaatgggctgactgttcagtgaccatgaatattcagaggaaattttttaaaatccttcacccaaagccaagaccaagacaaataatattctttgttaattgcttctaggattagttttctagctcatcctttcactaactgtgtatctctttgtgtacctcactttaaaaagcagtgattcctgtctagtttctggtccatgtaaggtctcatgggccttctccagtttccatgtgtactaattctccaggtcacaggaatgcacatgtatacctgttttatctcatgggctcagtgctagcttaccttcctggcccatgctcccattaccataggaagttgacaaatttacctacagtgaagccttggattatgaagcaccttcctatattacaaaattgcctctttaaaagcagtaaagcactgtggttaggaacttgaactttgtcaagtgacagacctaagtttaaaacttggttcttctgctttaacactaggtgtaaccttaacaagttacacaatttctccatgccttaatttctccatagaaaataagaataatagtgagtttttaaatgtaggttttttaaaataagaaagtgatacaattatctgtataaaaagcacatagagacaaaatatgcaattagtgtagttgctacctaaacgtatttctcactataaaaacatattttaccactggcaattccttcctcaagaataagtatggccctctctcagaaaattttatcattacaattgtttctcttttagctattttaattaaataaaaaatttgtggtattataaaatatgcatattatcaaaataaaaaagtcaaaatcactcagtttaataaaattagatcatacaatatgtagttttagaatttattcccttaacccaacaatatttcatgaatatcatttcatgtcaaaaatattttacattaactttaataagaatagttcgatatactgatgaccatccttcatacaatcaaaacccatgacaaggtatatatccataggctagatgacagggttatttaattttaaatagcaattgtttgtgtgcgttgaattatttctgttgcagactcagaaggaaatcatgaaagccctaagtctacctgcagatggctggttcttttttattcaggtgttaacttaaatgccacctccccaaagagacctttcctgaccactctacgtaacagcacttcagcagtcatgccatattatattatcactttatcctattttagtaatatgtactcatcatttactgaaagtgatgtatgtgcatcccatttctatacctcctcatatgtgcataaatgcatgcacatgcacacatgaatgcactgaaaacaagaaccttttctgtcttcttcgttgctgcttccaaatagcctagaagaactcttggaatatcactccaggaattcaataaatatttgtgagtaaataaatacatttcaaagataagaggaaaatttatacagctgcagtggatttccctggtggaaaactctacaaaggcatttgagtttagataatgtaagcccataagaaaattaactagattattctaacaggaaaggaataagcacttcaaactttatattttttattcttgttttaaatttatgttttagttgcggggaggatacaaaaagattaaaggacacaaaattacagctagataggaggaataagttccagtgttttacagaactgtaggaggactacagataacaagcattgtatttgaatagaaaggtccatatgtcatgtgccaaccccgttctgctgccttacccaagactgggaaatggaacagatgatatgggttctatagagaggcaaagtgcagaacctgctcaaacacagtggccctggggtggaaagttctcaattggaattgtgttggtgcctgtgtggatggagcattcaattctgagccttaggagccttttgaaggccctcctggccaagatgatcttgaggaaatgactgacccattggctgccttccaaatggatgacacagtctagacttttataaactacatgagtagaaggaacccagttgactggatttatcaccaaacctagcttgtgagcctcagtctagagctagcataatttagaaaaataaatgcatacatcatatattaaactctgagtatcatgaaacagatcctagatgttacaataataagaacctacatgggtgtttctcctgcactctgtcctggctttcttctgcttcttgtctaagggagcctggactcacttaagcagctctaataggccaaacaagagagtggtcaaggagtggctgaaatgtgaacagaaagactcaccattatattagagcaatcaatctatccttaaaatactgtgggtttagtgtcaagtgctagaggcttccccatttacccatacatggaagcctgaagaataaacagaactataaacttccctctgggcataaaacttgcatgtcttccacggcttcaaggtggggagcagctgggcaggcagaaggaggggcaagaggcagtcaagaggaggggcgggaggcaggcggggaggaatgggctactccgtttagctgatcagccttgaccagttcatgctctgggactccatcttacaagtcagacttttccgagtcacacagagcactcccttcactctccagattcaatgattcctgggatgatatagtaacgaaaataattccttattggataaagaaattgtgctgtgcgggagataagtagcttagaaaaaaaaatggatgaggagaggagctgggagtttgggggtaagacagcctaaaatctgacagtctggttggggaacgataaaagatactggaacccaaggaggagatcagtaagaatgtaggagaaagatctggtgggatttggagaagaaagtgttaaaaaataaaattggaatatgacagtttgcagactactaggtctgaaagacgcaactctgtagcaacatgaaggggaacaaactttgtctgaatagggaagtttctagtatgatctctgctttccttagacaagtaaccctggagaagacacttgacctctgagctttagattgttcatctgtaaaaaggagagaacaatatctgctgcctaccacctcagtgaggctgcactaaggatcagctcagaggaggcaaagcagaatgccctattgcacagcatggaggccctagagtcggaccaccatacttacatcccatctttaaaacctcctggctgtttggccttgagcaagccacttcacctccagaaagttcatttgatcatctgtaaaatgggcaagcccataggtggttgtgatgataaaatgaaaaaaaactttttaacttacatgagttacatgctgtagagtaagttatgtggtatatagtaagcacacagaaaagactcactgttatcaaaattaaaggaaagtggtttagtgtgctaagcactaaatacaagccagagagatgtcttgagaagtagacaaagaaatctacaattcagaatgaacagtaacaagaatgacatgtcctccaaattgagcttgggcagctggatctgaacctatcctacacatctgagtctacagtatgaggtaacagtctccacctatagctatcttctctgcctgtaaggtcattcctttctgaagaaagctgacctcagactattttgcgatcatttaaggaagagcgcaaaatactggagaaggctagtcttcaagctctagatacagaaaatcctcaaattcttgggtgttccctttcagactgagagtcagagccacaagcactgatccaaaaatccccttttccaaaaaaattttccatcttctaccaaggttcacctccctgtttagtgcacactagtatctacagttgttagagcaggagtctctccttatcctctaaggcaggtgttctgtgaagaccccatgacaagggacaaaatgaaacaacatgttcagggacaacaaaggaaaagcccattttatcaatgctccaaaacctggctacctcaggcttggcaagttattcgtgagcagagaagtttgtcatctacatggcagtcatggcctggatgggtctcgaactgtggcatggtaatgctctgagactaggtgccaggagaaagataaattcaatcatccatttctaccaggaagaaaagcaccaggaaggaatcagatgtacagtttgtcctctggggacctctgccttgatcctcaataaatctccttttagatacctcctcttagatgaaattcccacacttcacaatgctctccatggcttctgttggccttatggtcagctctgccaagatctgtattcttgggcaagacagaatccttctgaatctcagtctcttgctctataaatggaaacaattttgctctgcacaaattacaattagcatgtttgtgggaagttaaagtgtgaaactcagcataaatgaaaagtaatgtaccactgttgcttacatgaaaactcttgtaaagttgtcaggcactgtgcaccatctaagcatagcagtgttaggtatgggcccattagtgattagagggggtgcgaggcggagagggggtctccaagcagtgggtctcctggctgtggggaagctggctcagcggccataccaggagctgaaaccgaaggtactctgtgtgtcctctcaacaccatgggccccactttggcattatttccaattccctctggtttccatttgcttcctccctctagccccctggccaggtccgatttcaacaccaagtttctgagcttttcccattttgtccaccgtctctagaacatttctgcttcttttacctttcaaagaatccaaacttgaactctacttactcctgcccatcaccagcctgagctcagagttgctgagaagggaaagcaccctcataaggaagctcctcctttccctacatcattagacttgagcacagacagcatctccatttccacactgctctggccaggttgtgcctcagtcaattacacaactgtgtcttagtagccttggtagggcccaaatcaggatattctctaggaagattcactttgtactgagccaagcataatctcactgcatcgaaaatagaaaatgatcatctgatcattctggttcagactgtcagccctgagcaggtgggtcagtttgcatcacctgagtgcagattgcaaggacaacagtgaggctgcataaaaagaacctatgacaggatgcacatgagagagacaaatgtcttcacattgaagaaggggaggagtgcgccattggttttccatcctccagaggcactgagaaagctcctacagaaactgtgccccctccttctttgaaacacttcccatccttaagccttggtaggaaggagagaaatctggaagcccagaatcctatggaatgctgagtctcccttctccttaccccttagtgttggaattttcattccccaaaatcttgcatttgaccttcctgcacactgactggagagaagcatcttcatattcacaggaatgagccttagataagactttgctcctctcatgtgggccccaggaaactgaaatccaagctttttaccaacgcttgcccttccttaagtacattaaatacattcccaataggtggaaagatttgtaaacagctaggccattctccctccttctaaccctcatctccagggcctaagaaagcccagctctgttatctggggcttgactttccctgtcttccccatcccagtatccttgcaggaaacagccggtctcgctctctgctctcagaaggcaagtttccttatcacctgtgaatcacaaacccagagagtggccaaacatagccaggctgatgcaagaccctgggaagaggaaagctgcaggtgtgtttgtgctgggaggagtggtgaccctcacctcacagtcacctcctctctggatcctcgtgaggtataaagacgagtcctccaccaccagtcaggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtctgtgtctgtgcctgctccctctcactccttcacactggaaagcatcctccaatttcaggttagacacgactgtcccctttaaaggtaagcagagcccccatctcccaaaatgtgttccatggtacactagattagcacatacaaacagatggaatccaaaaataagaagaagcttgggagaaaggggagtactgttttctagagatacctgtttcagaaaggtggtctttggggtgggggggtgggtattgatttttatttgggcttctcacagtagttagagctactctgccttcagaacaattacagcacagaaaatgtgtcagcatcttcgaggtggcccaaaaaacctgaccagctgaatcttcttgctaaaatacaataataatgacaaatcctgttggtgatgacgtgcctctcccaggaatgtgtcggcaccaaaccctcgaccaagccctcccttctcattcacctggaaaatcagatgcaaataaatctccctggccgcctaactcttccctcagttccctagttccatctctgtgagcaggctagagagatgttccacctaccatagcaggagccagactgcgacttgggaatcaagcccagatctacacgctgggcttgattttcgtcttctttgcctttggggtaggatgccacagtgaatcccacagctaacaccagctcctcactctgaccagggaaagaaactagagagggtcaggattcacctatttgatcaattagctgaggaaggattcattttcataaaacttgcttgactttgagacacttcaagtgagttatttgggattctttaaaaggggtggaaggaaagatctgaggactgtgacaccaccagccactctgaccacacgttggctggcttgaacccactggatgcagcagagggaggcaggccctgtggcacctctggcacctgccaaagcctcctcctggcaattctgagagggcccatgttggggctgtagctcatccaagcttggcaccgaagatccaaggaagcttctctttgaaattccaccttcacctctgtcccaagtggttgtggacacccctgggagctggcactaagggccaggagcagccaagggagacagacaagttcagagcacatttccagttacagggaacagagcacaggcctccaagtgtccacagagcagcgtgcaaattgcagggatgagtagaggaaaacctctacatggagcacagcgttcctggcaaacacaggggactgcagtccacatgctgtggaatacacccaagtatgcatcagacacttgtttggtaaacagtaaatgtgtaagatcaattaccttgagagggccatctgggctccagatgtgtgacttgtgtgaggagacggctaccactcactatctccagaggaaaacagggctcagggctcgcacacaatggatagatacacacgggtcacccagaacatcaatacatacaaacatcactttgttcaacatggattttgtttttatggagtccaaacgcagaccgtagttcaccttacagccttgggtttgtctgcttttggagatatatatccagtagatagatagacagacaagacagataattttttccctttcttactataatgtcaatgccttatctgaatatcatcatcactcaagagtcaagggaagaaccaaacgcttcatataaacagggctgggctgggcagggagtgttagtttccagtgttttctgtctccattcagatcatccctatcaaagcccagctggtcacctcaagccaagacacagacataaggatcccaatggccttccagatggctgcttccacctcccacctgggccactaagactctttacacaggaaagtgagtcaccccagtgagaagggttgccagaagaaacagggcatgaaaatcacagataaccatgggatttcttccaagtggtcagtataaaatataccaacactaccatcaccaaaaacacaaaacaagcaaaaacatgcttattcaaaatcctagacaaaatactgtgtgagagccaggccacggggttgccttttcacaggccacacagctttcccagtccatgtactcacgtggaaccgtgagatgtgaaagtctgcagggcgtgtgctcaggatcgaggctggtactgttcacctatgggtccagaccaaagggcaataaggcagaaagctgatatctgtccaccgccacggcttagggcctccttctcacagaggctcctaagagcccccacctcagccttcacacaaaacatctccttctggctgaactacagccaggctggagtgccgtggcatgatctctgctcactacagtctccacctcctgggttcaagtgattcagcctcccaagtacctgggattacaggcactcgccaccatgcccagctgattttgtttgtttgtttgtttgtatttttagtggagacagggtttcaccatgttggccaggctcattttgaactcctgacctcaagtgatccaaggtactgggattacaggcatgagccaccacttctggcccaggacccattttttaaaaaaattttcaacttttattttagattcagggcatacgtgtgcaggtttgttacatgggtatattgcgtgatgctgaggtttggggcacaaatgttcttaccactcaggcagtgagaatagtgcccaataggtagttattcagccctttccaccctccttctctcttccctctagcagttacagtgtctactgttcctatctttatatccatgtgtaccaaatgctcagctcccacttatacagaagaacgtgatatttggttttacatacctgtgttaatttgcttagaattatggtctccatctccatccacgttgctgcaaagacatgatttcattttttcatagctgcatagtattccatggtgtatatgtaccacatttcctttatccaatctacagctgatggccacctagattgattccatggctttgttattgtgaatagtgctgtgacggacatgcaagagcatgtgtctttttggcagaccaattattttcctttgggtatatgcccagtaaaggaattgctgggtggaaaggtagttctgtttttaattatttcagaaatctccaaactgccttctgcattaatttttccataaactaatcgacagtcaggccaagagtgtataagcattccctttcctctgcagccttgacagcatcttctattttttttttttttttttttgacgttttaataatagccactctgcagccaagctctttcaaggccaatgtgggatagagccacaaacatcccttttccggaagagaattcttgcctgcccactggtagaattcttgttttcatctgtcttttattatttgtttttcaaagaaaaactggcctgtaatcccagcactatacgtggccgaggcgggcggatcacgaagtcaggagatagagaccatcctggctaacacagtgaaatcccgtgtctactaaaaacataaaaaattagccaggtgtggtggcaggtgcctgtagtctcagctactcgggaggctgaggcgggagaatggcgtgaacctgggaggcaaagcttgcagtgacctgagatcatgctactgcactccagcctggacaacagagccagactctgtctcaaaaaaaaaaaagaaagaaaagaaaagaaaaaaaagaaaaaccaaaggtaaagtggtaagatcttccacacctgaaccagtttgtagccaccagagcctgctgcgaaggggcccctcaagcatgcattcatcttgtcacctggaatttgagagatcaagaagccccatagcaacctaccatgcaactgcccatcagtgctgatcctttcaagggattatctcaattctgactctgcagacactggcagccacaggtgacaaaccctgtgtatctgtgggctttcctcatcacccagggccacaatggggtgcctgccctaggcagagacacagcaacattctcttaaactgaaattaagcataaatccacttcaccaataatcatctgagggctcagtccctgtctccttcctcggggattttaaaacacacatttctctgaccaaacaggtaggtgagatctgactttaaaggggggaaattgggttgaattgaggtatcaggaatggatcacaagtgtttttgtgtggggacaggcatccacatccctaactgtacctggagatggagaaaaatgcaggagaggagaagagaaaaaaaggaggaaaaagtggctgaaagtatttgaaagcttctctcatggttctttctggctctggttgcttttccaaggtcttgagtgcaggcagggccagctctggctgggagctgctgctctgggacatggaagagtcacttcacctccagaaagttcattcgatcatctgtaaaatgggcaagcccataggtggttgtgatgataaaatgaaaaaaaaacattcttaacttacatgagttacatgctgtatagtaagttatgtgctatataggaagcacacagaaatgattcactgttatcataatagaaggacagtggcttggtgtgctaagcactaaatacaagccagaaaaaatgtcttagagaagtagacaaagaaatctatagttcagaaccaacagtaccaagaatgacatgtcctccaaattgagcttgggcaggtagatctgaacctatcctacacatctgagtctatgatatgaggtaatagtctccacctatagctatcttctctgcctgtgaggtcattcctttttgaagaaagctgacctcagactatactgtgatcatttaaggaagagcacaaaatactggagaaggctagtcttcaagctctagatacagaaaatcctcatattcttgggtgttccctttcagacagagaatcagagccacaagcactaatccagaaaccccctttcccaaaaacgttttccatctcctaccaaggttcacatccctattgagtgctcactagtgtctatagttgctagagcaagagtctctccttattctctaaggcaggagttctgtgaaggccccatgacaaggggacaaaatgaaacaacatgtttagggacaacacaggaaaaacccatattatcaaagctccaaaacctggctacctcaggcttggccagttattcatgagcagagaggtttctcatctacatggcagtcatggcctggatgggtctggaactgtggcaagataaggctctgagacaaggtgccaggagaaagatgaattcaatcatccatttctgccaggaagaaaagcaccaggaaggaatcagatgtacagtttgtcctctggggacctctgccttgatcctcaataaatctccttttagatgccacgtgcagcaattcccacactttacaatgctctccatggcttctgttggccttatggtcagctctgccaagatctgtattcttgggcaagacagaatccttctgaatctcagtctcttcctctataaatggaaacaatttggctctacacaaatcacaattagcatgtttgtgggaagttaaaccgtgaaactcagcatcaatgaaaagcaatgtaccactgttgcttatgaaaactcttgtaaagttgtcaggcaccatgcaccatctaagtacagcagtgttaggtataagcccatcagtgattagagggggtatggggtggagagggggtctctgagcagtgggtctccgggctctggggaagctggctgggtggccatactaggagctgaacccgaaggtactctgtgtgtcctctcaactccacgggccccactttggcattttctccaattccctctcgtttccatttgcttcctccctctagccccctggctgtgtccaatttcaacaccaagtttctgagcttttctcattttgttcactgtctccagaacatccctgcttcttttacctttcaaagaattcaaacttgaactctgctcactcctgcccatcaccaacctgagctcagagttcctgagaagggaaagcaccctcataaggaaactcctccttttcttacatcattagacttgagcacagacagcatttccatctccacactgctctggccaggttgtgcctcagtcaattacacaactgtgtctcagtagccttggtagggcccaaatcaggatattctttgggaagtttcactttgtactgagccaagcataatctcccgggatctaaaatagaaaattctagacccacccctccacatcttcgttattgaacccaatatgtcacccatttaccatgtgctcaaatctctacctactgctgattctcagatcaaatcgtaacccagatttaccatggtccaaactctgacatctgattggggccatgtcatcctggttcaggctgtcagccccaagcaggtgggtcagtttgcctcaccctgagagcaggttgccagggcaaccatgaggctgcataaaaagaacctatgacaggatgcatatgagagagacaaatgtcttcacattgaagaaggggaggagtgcaccattggttttccatcctccagatgcactaagcttctacctaaactgtgccccctccttctttgaaacacatcccatccttaagccttggtaggaaggagagccatctggaagccctgaatcctatggaatgctgagtctcccttctccttcccccttagtgttggaattctcattccccaaagtcttggatttgacctttcccgacactgactggagagaagcatcttcatattcacaggaatgagccttagatcagactttgctcctctcctgggagctccaggacactgaaaagccaagcttgttaccaatacttgcccttccttaagtacattaaatacatcccaaatagttaaacagattcctaaacagccaggccattctccctccttctaaccctcatctcctcggcctacgaaagcccagatgtgtgatccagggcttggcttcccctgtcttccccatcccagcatccttgcgggaaagggctgctctctctctctgctttcagaaggcaaatttccttatcacctatgagtcacaaacccagagagtggccaaacatagccaagctgatgcaagaccctgggaaggggaaagctgcaggtgtgtttgtgctgggaggagtgctgaccctcacctcagagacacctcctctccagatcctcaggaggtataaagacaggtcctccaccaccagtcaggcacactctaccaccatgaatccactcctgatccttgcctttgtgggagctgatggcgagtttcatgccatgcctcaggccccaaccaccccctttcctggcagacacttgccctgccattcttgccacctttcccattttgactgtgttctgatattctatttcctccatctctccttcccatcctcttcggctctctttaagcctcacctgtttcagcttctccatgatttcactcccaccactgtcattcatccatatctgagctgtggctggagaagctgggaagggagaccaggtggggcgggcccacaaaatgaagcagcagccttcaggcttggctccatagcaccagtatagcaccattatatctgctcttaacctcaaatgcacctggggaggttgaaaaattactcatatcagagactcagctttagaagttctaacttcattctctggggtgcaacctgtgtactgggcttttaacattcccgggtgatttttaacatttccatgcatgcagccaaggttaagaattgctgttctattggccaataacaatgtctacctttgttctgccaaagtgagcctgggggctgccctcaactctgccctgactacacaaatctgagctatgggggaagctggtcatggccaggtctacgcagccagggggttttcctagcttggccaaagtatactgacaatccagggctcaaatcgccaggggaagtacacaggtgatgaataaaagagagaagcactcagtgggtgagacaaccacatcccaattcctatcccactggaagcattgtgaggacattccttgaatcctcagcctggtgaccccggggagaactgagcccctgcagggtacctagctacatgccctgcagacacagagacttgggagccacatgcagtgatgcttaccaggggtgacagcgctccctcccttacccagcctcactgtgctcgttaaggatttctaattagcaggaagcaaccgaaggctgggagcgctacccctaacatgctactgacttgccttctcctttcccatctccactccagttgcttcccctttcgacgacgatgacaacatcatttagtggtatacctgtgaggagaattctgtcccctaccaggtgtccctgaattctgggtaccacttctgcagtggctccctcctcagcgaacagtgggtggtgtcagcagctcactgctacaagtagtaagtgtggggcccctgactgcaaagctcccagccaggctgcctgggagagcttggcttcagcccagggaactactgaggttgggtaagatggatgggagaggtggtggagaagaaaacttgttggcagcagcggactctccagagcagagagcgaacacaagacaggaagctctcacacccaggcaaatccatgaaacagcaagggttgtggtcataaaagcaggcagggatgatcttggtgtttggcagagctagtaagaacagcaggcaagtaccctttgctggttagctacacatcaaagtcacttaagaaagagtttttaaaagtactgatgcctgtgtcctatcccagggcaattatcaggaattttcaggaagagggtgtgaatatcagtgagtattaaacattctacctctggtaactgtagattgtatagacagagctgagaactgctccctacaccaagaactctcaaacctgagtttgcctcagaaccacctgcagggttgttaaagcacaaatcactgggacccatccccaaggttctgagcagtaggtgggggtaaggaccaagaatttacatttctaacaagttcccaggagatgctaatgctatggctacccttaggttagattacacagaagggtggtgctcaccaggccaagaaaggagggaggaacaggcactgtgcacagttagcaaaggcctggggtgaagaatgctgggaaaacttcaaagagctccttgtgcccacagtgctagtgactgtggagattgtgggaaagaggctgggaaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgccacgcctgttgcatcaataactattccacagaacagcatacatggtcaaggaatatttttaatatttacaatgaggactgagtgtttgctaaatgaagaaatcaaaggagtacattctggagggctggtagactcccagagccagggtttttgagatgagagtgaaaataagcaggctgagagcagaaagaaagaaagttctgcagatagaagttaggatattaccacttcggccccagcccagccagtaaatgtttagaagcatagtagtaattagcaggtaggagttgtggggaggaaaggaaactgacatgatgggaagcaggaccagctacaaaatcttcaggaccagctcagaatgaaaatgccggggctcgtgttaaatcttaggatttcaacatggtgacagcagagcactaaaccaagcagggggcccttctagcaggaggccccatggggacctaggaaggaggtcacatccatacaaatgtaaagaaatgtcagagtaaatttcctccattgtccaggagattcggaataggttctcctaagactgatatttcttcattttaatagagttgctcagaaatgaaaaacaatcaatgggaagaaaaagaaaaaaaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgtatcaacacaactagtagcaagaagttactctgatgatatcagatgtttatttgggaaacttgctagtagagaaagctacatataatatttggatgcaaagggacacagaaggttgaagagtccctaattttgaaataagggaagatgactaactgtctgagctgagaaaactcaggggtacctggaggcagaggaatggataagatgacttcatgcaccacaaaaagaaaaaacctcacattctcatgaacgcactgtaaaaccaaaggatgtcctcatgtgaatgcaaaaaataggccatctgtaaatccaaagaaagcccccagatctaaaatgtctccctcatcccagattccccttcattcctgagcaccttagatttggtataaataacctgcttgggagggggctttttgaattcgtacataatttaaccttcacacagtttctgcaaagtcagaatggtgattattacctcacatgcagaaaaaagtgataggaatttctgtcttaaaagtcttgttggtggacaaaggaagttctaggatttggatcttgtttttttgggttccaatcccttgctccagttaaaaaactaccacataaaatggtgagaagtaggtaggcaagtttttattgatagagaggaaatcaaataatggcaatgaggagacatcacctggaatgttaggcagtgcctaactgggggatggacagacaatgggcagtgccaacccatagggtggatacaaaagacaggcaaggaaggggtagaaccatcaaagaggaataggctggtgaccccaaagcaaggaggacctagtaacataattgtgcttcattatggtcctttcccggccttctctctcacacatacacagagcccctaccaggaccagacagctctcagagcaaccctagccccattacctcttccctttccagaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcggacaagactagatccagaagaaagccagagtggacaaggtgggatgatcaaggttcacagggtcagcaaagcacggtgtgcacttcccccaccaagaagcatagaggctgaatggagcacctcaagctcattcttccttcagatcctgacaccttagagctaagctttcaagtctccctgaggaccagccatacagctcagcatctgagtggtgtgcatcccattctcttctggggtcctggtttcctaagatcatagtgaccacttcgctggcactggagcagcatgagggagacagaaccagggctatcaaaggaggctgactttgtactatctgatatgcatgtgtttgtggcctgtgagtctgtgatgtaaggctcaatgtccttacaaagcagcattctctcatccatttttcttcccctgttttctttcagactgtggcttcacctccggtaagtgagtctctcctttttctctctatctttcgccgtctctgctctcgaaccagggcatggagaatccacggacacaggggcgtgagggaggccagagccacctgtgcacaggtgcctacatgctctgttcttgtcaacagagtcttaccagcaaggggtcctgtctgccaccatcctctatgagatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaatggtgtgttgggcctggttgcatttcaggagtgtctgtggagttctgctcatcactgacttatcttctgatttagggaaagcagcattcccttggacatctgaagtgacagccctctttctctccacccaatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaaggcagagttgagacaactgatatgtaaagcctggggaagagtgatttctcaggagcgagacacactaagtcaggagcaatgggatatagggcccagtgggggctgaagtgctatgttcagagtagcccttccaatgggcttcttcgtttgatggatggaaaccaaaccactccaaacacaaggtgttaactgctcctacttgggcaaagacagttatcctgtcaaggtaaattctgcatacaggctgaatgcattgtggtaaaacactacatggaggaagaggaggaatgggattaaagaaaaggaggcctagaacagtgagaggggctgagagaggccatgtcgaagttagttgaggaagactgtcaggggagagaagagaagtctgaaagcagagaaaggttgggaaagaggagggagccctttgttgagagcctgcttgcttcaggcctcaggctggacgctgctacctgtgctgtctgcatctgcacaatgatcccaggaacaggtattattttccccatgttatagatgtggaaactgaagattacagttcaaattacttatgagttgtgaaaccgtggcatgttctgctgaagatggcaattctggaaactttttccaagtagttaccaggatggtgggattgctcctggtatctgggtgatcctagagcagcttctcccaaactccaggcagggcccatggtaacacactgaagacaccttaatgccttggtgtctttgtttcccacggctgccgtaacaaagtaccactggtgggtttaaaacaataaaaacttattctctcacagttctggaggctaaagatacaacaccaagatgtcagcgggtcatcctgtatgacagctctaggggagaatcctttcctgcttcttcccatgtctgatggcttctggcactccttggcttgtgccagcatcgcagcaatctctgcctctgtcttcacatggcattttccctgtgtctctgcatttaagctcccctctcctttctcttttcaaggcatggtcttaggatttagggcccaccctaaatccagaacaattttattgagagatcttaacaaattatacctgccaagtccctatttccaaataaggtcacattctgagtttctgagtgggcatgaattctgggggaacactcttcttcccactacactggggatcttggaactggagaagagggttctctggtggcagcttgcaaagaccaggaaaggatgtgctcacagcagggatggggcccaggaaactcatcacatgccggtcatttccatcagtcgtaactatctctagactgctcaaaatgcagtatagtattttgttggctattgttgttacatatgtgctggtttgttttcatattggctaaaaaaaagcctaaaacaaaggggacaggctttaggccctagaccaacattcatgcttcccactccttagacctgcgtggaggcagcaggcatatccttgtggctcctcgcaaaggtaggacaggaggatgagcagccgagggaacaaggaagcacttcagagagagcagaactgtgggggccagagggcacaggctaggactggggatattggaggatagtggtttgtgtgggcagagctgtgaggggctgagcagctgtagtgcaagattagagtggaggtgggaagggggaaacaccttgtagaagaaagatagtgtctgttagtttgatggccatcatcttggggacgtggaaaacggaggcattagcaggtgggaggatgtgggaggagtttcttgttagtaccctagagtttgcaatcagacccaggtgaatgaattctcctctggaggataaaaggccatgtgaattttaccctctcagtccaggggacttgacagagatggagagagcttcaagctccatctggtcctcccaacaccctacttgacccagggcaggttcctcttcccaagtttttacagccatttccttgtctctctcaaacaacacccccaacattcagcacgcatgcactgggaagtgaatctcttctgcctctacctgcctttttctctagaatcgaagtggattcttctgggccaattctgggcatcctctccattcttcctcaggtaacactgagaaaagatgagttcgatgtagggcaatcatataacttactgtaagaattgagataccattgaaaatgaaaggggcccattagccacatgggatgctggaacaagaggagtaaaccaggaatggtcacaaggcccctccagtggagaggctctgagggagtttctgggtgcagcattattcctgcaaagggaggtactaaagggactccacaccaacctggacttgttgactgtttcaaacctcagggctgacctaagcatcatcctatgaagaaaccatgtggacagaatatagggcaaggcagggacaacagcatcctacacaggtgacacccagtgcagagcaaagcatgcttacttattgaaaagagttacaagaaaagcatctctggaagaatgtctagggtaccccaagttctcgctgaacttagcatggagtagctcttaaagagaagaacttcacctgtgacctttacagatttatttgggaaattggaagaaaaagggggtcatccaaatggttgcgtaataaaataacttctttgtgggggaaatgggattcccgtgagcatcccagagccccagtcaccatcacttcctgagaggaagaatcttcccatcagcaccagtatccatagagattttcctactactaggctcattgctgggccacataaggttggggagtggggatggtcgggagctgctgggacaatccaagagaaaaaggctttttctctctcgagggagtgatttcataataagagtttgagataagggcaatggatcctaatagatattaaagtctccatttccgtccctgagccatttcctcatttttcttctgtagtggcccagaaaggaggggtggagatagactgatatcagcccctaacagtctgtgtgacacacagccccaaatgtcctatataggagaatctttgtgaggtttctctggttataaatgaatgtgggaatggaatattggtgctttgagacctctgttgaagctgcatagtgaaaacaaaaatgagtttttgcttcttcctcaggtaacactgagcaaagatgtctagccatattttcatttaggggtgttgggagatgctggtggagatcacgggaatggctaaaacccagaggtgaactcagctttgccatggacccatgagtgaatccattttctgcttctctactgacatctcagactcatcaccaggttcacttttaccatgtcctagaaactcccctatgctatataagaagactcatagtatagaatggcatgaagcatggccaacagttttaatcacagttcatttccattgcttgtggcaaactcccatggctcccaaaaagctgatttctgaggcttgggaccccataacctaagactacccaacccacctagactcaaacacaacatattccctgccttattctagggttgaatgttctttcctcctatctggaagccttccttttcttgctgtctgtgtttgtgaatttgaagttcctgggttccttaacatccctacatctctgcctgtccttttattttttttattgtggcagaacttatgaatcatctccctccaacagacatgatattttctattcgccatccccctctcctatagactcaactacatgcctttctctcccatctctatccatagtctttatctctgctgctggtggactcctgagagggcttcttggggaatatggggccccaaaaatgagtgaatggcttctgtaggtcagcaaaaaggatctgaaaatgagcctacacctgtgactatttccaaaggatttttatcagcttgctctgcaactgatctcaactgccctctgtgaatatgagcatttaatccacacaacatgtaaagctaattctcagctcctttttgccaacctacagttgctattcacttatctctgggaccctatagtccccccaaaagccctctcaggtgtctacatgcaacagagtgcccatattctggcaagaacccataaatctatgcgagacagaatcattagaaactttaaaacttgagtttttggaatggaaaaaaagcatgtagtggatggatgaaaacattatcatagcaaagaagatgttgtaatgcagagacctgggtttaagccttagttctgtcatttatcaactatgtgaccctgggcaagtgatcacctctgagactcagttttccttgctgtaaaatgagctcaattacaagcccaacttcataagatcgttttatctcatttaacccacacaacatgtaaagcttttagaacaatatcagtaagtattaggtgttattataactactaccaacctgaagatttttttcaggcaaaacattttcagttttctcaattttgttattatagggcacagttttgagcacgtcctactttccatagcccaatcactcccttctgaaaacattaaagtttgtttttatccctctatcttttaaaaaatgtgttgtacaggacctgacccagcaccaggtgggttctgacctacaaagagtaaagggggaactttgcctcctctttctcaacatcttatacgttagttggttccattaggacaatttatctactttttgtacgctcaccatcccgttgactcacagagctcactttgactcaccccctgggtgttttttcacatatccttctttcacatattccccttcctgtgttcatatagatggttttctctgtttggtgggggaggagggagagagagaatgtttatcatgtttattcagcttatctctccaacctattaagattctgcaggattctaattttgtgattcattatatttatccttctatcctcatgccatctcagatatgatcatcttgcctgattcattactataagagtgattcatgaaattcatagcaagatcacagctcaacagagaccccacattccccaagccttgtctgaagtccaggagctgctaaaacacagagaattagcttctggtcctcctctggccccagctgcatggctctgaacaactcatttttattctctgggcttatatgtcctcctctgtgatatgaggacattgggtaaagtgatctctaagaatcttcaaactctgctcttcagattctctgattcaaagcctgcagtctctgaagtaccaagagaatgggaactcagagaagctaagctcttcctggcctcaaatcatacatatctgtgacatagtctcagacagtctgatggtggaagaggacagcactggcactggagtcccacagttagcaagagtcaactggagccctgacacctgttccctggccctcctccatcaaaaaggtctagggccatgaatgacaagaaaattgtgttaaaaaggagagtggccctgaatcaaaaggtgggaagtaatgagatggaaatcggggtcttttaggtaatagctgacaactggggtaggaatgggggttctgagcccagtgctggctgccgggctgtttatctctgagtcacatcagcaccaagccacagcagccacctgccctagctccatctcttacagtcacaacaggatgtggtttgacatttactgggtcctgcatctggggtgcctgtgaaagttgctccctccacccacccaccttcagagcatcatgagaaccacactcaccgcatccggcacccaaccccctcctatgctgctctttctacctgggcccctggttagcatcctggcagtagaaatagaacttcagaggggaggggcagggtctctagaggggaatctaggtatcccagatccatgtgcaggcctcccctcccccaacacatctttacacctgctggaggttatgcacaagatcaaaggccacagtgggcaccatgaagatagtggagaatgaaaaacagctgcaataactgctctgacccagttgggatcccttctggtcccacatcactcaggcaactctctcttcccacctgccccccaaactcccttccacctccctccacatgtatcctcccacttccttccactcatgtaatgagaggtgctgatgagtcacaggagaggtagccctagataaccaacagactgcaaaacggacagtccctggatgtctgagccagtgtttgtgcactgcattgactggctcctcgtagttttttcctgtagttgctaaagcctgtaaggtctgtgtgatgaatattttctaacacatcttagaagaacataatgcaagacagaatgaaaaactagagaggcagaaacccccaaagtaagtagtgggaaattaccaggtatataataggtcaagcctgctctgcaggagctcaagggattgtagcattcttatcccaaaccactgaatcctgggcaaaaataagaagtcgcctaattttagtattaccagcttcccaaccccgggcattcttcatcttactcaagctgtccagaggccccagggtgactccctataagtcccatgggtggctgagatctatttagaggcacaagggtatctccttataagtcccatgggtggctgagatctatgagaagcatcttggggagagtgcctctggccaccagcatgtggccctgaatcttccatgtgcaactggccagggaaggagatatatggaaatagtcatcctgcacatctgcaaaatcagatgcaaatcctggaagctctcctagaaaagagacagcctcatctgattaaaggggcaagtgagtttgatgaattattggcaagagacagcatgtctgaacaggatcggtcatcctaaactgctttcctttgtcccctggaattataatgactgtggatttctgagtcctagatggtatggaaacagttatgggaatgaacagtcttgcatgaataagagcagataacatggaggatgttaatttgttctgctgaatttaggtggctttcaagcctctccttcaatgctcacctgtctctaggatgctctgtgcaatgatcaggactttttttcttcagattctctaaaacttacaatattcacatagacctgcacatttctacacaaactgactctcctgcttgcaatgtcattttgcttatataactattagcctcctaaagagctaaacttagctacaattttatgtcctttgtgaagttttccagaatttttgcagtatattacaggaaggaaaaatctgcctcaagtctctactaattctacttgactagtggtgattgcctgagacatttctctattaatgaggattctgaagctgtataaagcccctacagaatcagcatctgaataggcacagcatagggttcaagtttcatggttttgccatccaagcatgtttagcattttaaatattaatatttattacatacttgtagtttatgatttgaaattttttaactaagtcttcctcttgggtaagttgtaatgaaaataatcttgtaagcttaaggagcggaaaataatacctgttgaaaattagagcttgtaatagggctttataaacaccatctcatttaatacacataacaattcaatgaggcaagttttataggtggggaaaaacttgaaacttagtaaaattaaataactaggtcaagttcataacaactagcaaatttttagactacaaaaatcaagtgctttgactaaatcatgctatgactgtgcccaacaccatctcgagtacattttatttttctttttaatcctcaaaatgactcactgtgtccagcaaataatagctgcttaatacataggtgatccttaaagttcagtagggacccctgggcattattccatatgttcttgatcactctgtgtctacatctcagattttccacttcagattaaatgatactagaaatatgcacgtgtctggattgatctaggttaaatgatgcccggaatggagtattttaagacatcttgtgcccccttgtggaggggaagggacattagaaagaaaatctttttaagaacaaggactagggagggatggggatgaggaaggaagctcagttgccaaggtaaccatcgaacctcttcccagccatccacatcagccttttcctctccttcatttccatccaagtgatttctcttttttagagctcaaccattacacacacggtcctcttcttgcgtatctcttggatcaccatctgtctgtctttgctacaaaggaagggctacaagatagtacaacaggacattttttaaaacctcaaacatcaccaaaatttctaagtgcaagtttatttttattttttttttttttgagacagagtctcgctctgtcacccaggctagagtgcagtggcatgatcttggctcactgcaacctccacctcccaggttcaagtgattctcttgcctcagcctcccaagtagctagtattacagacgcctgccaccacgcccggttaatttttgtacttttagtagagacaggtttcaccatattggccaggctggtctcaaactcctgacctcaggtgatcctcctgcctcagcctcccaaagtgctgggattacaggcatgagctaccacgtctggcctaagtgcatgttacctatactaacaaaaccacacttctgcctcgaatgagaacagtctcctgaacatcttgcctctttgcctgactcaaagcctcaggtctaagcctccccataatttctagtctcagcagaaagatcaatgacaggagactctccaggtgatgaaattaaccaattaagtaacctgggttggcatcctcccgtttgttcaccagctcacctcctgccacaggtatatcctttctctcagccatatatgcacaaaccccctccccacggcacacatagaagaatttggaagactagaaaatcaggcaaggtatagcacaccttgagggctggagtatggtagcctgggccgggacatccatacattgagaacttgactatgtgcaggcaaatcacaggttctgcacacatacaattttttgttctccctgagaacttagtagagtcttttgtagaattctcgctttattccattgctttcacattggccagcagtcagaaacctacttacaaatatcctccacccagtccctaagtgaaggcccctggggagtatggttagggctcaggagagggtggggtttttgcacagatgtctgccccacccagctcagtgtgacactccaggcacagagatagaagccagagtcactgagaaggagcttcttagaactcaggatgaactgccggtcctggggtctggaggctgagagattctggggcacctcagagctgatctggccaataccaacggagtagaagagcagctggaggcccctgcctgcagcctgtcggtaccagtataggttggggtttgatgttccctccacagtgcactccagagagagcgggctgcccacaggctgcaccagggtcgctggccattgatgaatagtctgagatctgacccctgtgggaaagataaagtgccatttacagaggagcaccccagcctggcttgccttccccagacagaggggcagctcaagctcttgcatgacacaggcacctggaatccatcatggggagtagactgggggagccaagatgcaaagcatccctgggccagggaagaccaacagaacgaactccttctcaggagatagagagaactaagaatcatcagatcagcccctaaggctaaattcccatatctgttccagacaatcaggaatagactcaagagtgtcaaaccaacagctcagactctgcattcacgggattggggtgagggtgaggatgagaaaagaggcttgccagagaggagggcacccaccaaagaaagtgcccaggagaagggcaaggagagagcagagcat

SEQ ID NO: 148 - DNA, 61294 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagtaagtgtgtgctgcgggtttgtgctggacaggcccttctcggcgggcagcccctgcctgcgactgaaactgcctaggctgagaagcagcattcctctatatagaagggactcgctctttcttgtgtagctccccgtaaggaagacggacagaatttgtagtagctgtttatctagttagcccctttgtatccactgttttccacttactgcccgttcacaaacttctccggctaattgcatggttttttgactcaacgtaggcgctttaactttcctattttcttttttccattccactattggtcacaattcaaaccttagtggcgttttagccacccagtgaaggggtgttagagtaccacccaaagcaagtcctggttctgcatctgccttgtgtttgcataagctgttaaatttcctatggtgtctgaaccactcatcacatttcgattgagagtcaaacgctgtgttcagttaggaatttgccggctgaccgcaaaaaggtacatttaaaataagcatttagtcgaaagactctgtattcaggaagagcttggctactcccctccccctgttatagctcttatccctcaccctgttcctactgttttgaaacccgttacaaaaaggggaaagaagtatttccgtcttcaggcctctcagtgtaggtaggctacatttttagcaccagtttcctttatttgctttgttaatgtaatccttctgttgaaaactgttttgtaacttcctggaaaacaaaacaaaacaaaacaacaacacggaattggcgcaggagggctcgttttatcctcccaatttggtgagatctttttgttttctctttactattgcggtttttcctccacagatttcttcacttcttacctagtctattccctctttcctccctcatgataaacagtagactctttcgtccttaaccaactctcttgcagctctttttcattttacttctcagatcttgatcttttctttgtggctgctcccaggccaccctcctccaccatcagtctctgattttgtgggttttgagagattgacctgggagagcatcacagttgcatgtttgtacacacacgctgactctaactagtggtttttctgtatgtgtgtgtcagatcatctactttgacagtcattacatgtgattctcaggctgcccgaaagactgaacataggcagtgagaaagttataaacgtgaacattttgtggggaaaaatacaatgtggagtctaatttacctattgccacttcattgctggatgaaggcacaagtcttaatttcttgtagtcttaaaaaggaacagttgaataatattaaactggaaggaaaagggggatctgatgaaatttcagcgttggtctttcactagattttcattgataaaatttttaagaaagttgtcagggcacaactttaagaaattgtcacatctgaacataaagtcctgagctccagagcaggaaagaaattagtttgagacaatagggctgtgaagactgaccaaagtatatagttgggacataagcttaaattggattcttgaagaagatgatgtcccaaatctttcttgatctgctttccttagttaatttagctttccaagttaagctgagacctcttttctcttttgtcttcctgctttcacctgtccttagagaagggacagcagacagcctggctcttagagcaaatgcttctcatagagatgctattaggaaataggtacctccttcctcaagagttctagttgttggggttttaagtcacgtaactgtacatattagcaggtaataagggacaggatgaaggagggatgacctttaaactctttggatttgatctgcttatattaattttagggacgcaacttcaggatctataaatgatattcaggaattcctttcattgtacttcttggctgaaagaggttttggtaatcgtgtttgaacatgtaatttattcctaaaaaacaagggtgtttgctttgtggaaatgagaaggcaatcaaaataaccacccaccgtatattgagcaaccaaccacagtgtgttaggcatcatattaggatcaatacagatacaatcagagtatttttttttttttttttggagacagggtcttgctttgttgccctggctggagtacaagggtgtaagcatggcccactgcagcttccacctcctggactcaagctatcctgccatctcagcttccgagtagctgggactgtaggcacacaccaccatacttggccaaatgaaaaaaaattttttttgtagagtcagggtcttgctgatcatttgatctcgaactcctcggctcaggggatcctcctgccttgtcctcccaaagtactgtggttacagacttgaaccacctcacctggccacaataatcttaattctgtgaagtgagtagtgttattcctaatttacatttgagggattttcagctcagacttggcagaggtctaccacttactataaccctggctggtgttcaaacttaagtcattcagatatcaaacccatgctcttttttaactacgctagttataggtagaacattaaatgagatgtagattatttagcacactgctggaactgcaatttgatacatatattttgttgaaagtgggtgaatagcactagctttatatgtgagtaatcatactctatggttgggctgtgtaaaactttttattaggtgactgtacaatgtttatttcagatagtggcttaaaagccacttttgtatttatccacctgaattatgcgcctgtcagtatactgttaacagatgtcagaatatggtttttttatgtgattgcagagggagacttcaattcagaattttatccttcataacattatagtgattttaaaagttatatgcagcaaatgtgtagtatttttctcatttcaactttcacagcagtaggcaggtggttgtatccctttttttatagattagaaaagtgggactcaggaaaagttagttcacttgttggaaattctgcagcatattaggacttaaattcaggttttctgactaagaatctgatgttcttttttatttacatcatgtatattgcatgctctttatgtcagggcatggtaatcagatgatacatgatagtctgtggcccattcagtgtaggctttgttttcccctgaatttctacttcaaacatgcttatctggccgctgtttatgcaactactttaaaaaaggaaccataagggaaaaatgaagtcatacaggagaaaaacagaaatgtaattgtagccactgatacaaccaagctcctgtttccactttctctggtctttttgggattttctcctttttgccgttaccctgccctttgatcctatgtccttgcttatgcttgttttcatcaagaagagtctcaatgatatgcagtagaaagaaaccatggtctgctgttttgtgaagagtagtgtgccttgacttgggggtacaggaggaagaggaatgcagaggagtgaggatcatgggaaaatgttgaacttttctgttggagtttcttcgccactatgaaggaaaacattttcccattaaaatagaaatactagaatcatatacataacatttttggaatttaatccaaaacttcatctgttccgttaaaacatacataaagaaaaggagtaataaaataggttgggactaataagcagcagattatattactaagatttttcactattactgtagttaattagttaggtctggctgattatggcttttagagcaaagaataggatgaggaaaatgcagctgttttattatcactaacagagatgtggtgaacaatcctcttagatgttaaaaacgaaactgacccaggaagagagccctcatcagtaccagaccatgctggcatcctgatctcagactttcagcttgtagaactgtgagaaaataaacttatgttatttaaacctaaatacataagtacacctttatctcctttttccattctctttgtatgcttgggatccaggatacacaaattgaagttacttgtttaatgattttataactatgtcagaatttaagttaaaagtgagttactctgtatgtagaaaggctgaaaatagtacaactgcagtaattctgtcagctataagggacgtgtggactgagagggtagtcttaatagattgtgatcaactatatgtgaaaacattttgtgtagtgagttgatgtgtagtttacatgtaaactaactcctttagttcgaaaggaattttattttacgttaaaagattattttaggctgggctttagtggctcacgcctataatcccagcattttgaggggctgaggcaggaggatcgcttgagcccaggagttcaagactggcttgggcaaatggtgagactttgtctctaaaaaaattaaaaaattagccaggcatggtggtgcgagcccatggtctcaggtgggatgattgcttgagcccaggtgatagaacaaaaccctatctcaaaaaaaaaaaaaaaattttttttttgtatgtatgtaactctttacttatctactacctaataatccacaaaaatacccacaaatccttaattacgtggaggaggaggagatgataatagagatcattttaactttgaaagataatggattccgggccagatgtggtaactcacccctgtaattcccaacactctgggaggctgaggtgggacgatagcttgagtccaggaattcaagaccagcctgggcaacatggcaatacctcatctctattaaaaaaaaaattattaagaaagaaaggggccaggtgcggtggctcacgcctgttaccccagcactttgggaggctgaggcgggtggatcacaaggtcgagggattgagaccatcctggccaaccaacatggtgaaaccctgtctttactaaaaatacaaaaataagctgggtgtagtgttgcatgccttttagtcccagctacttgggaggctgaggtaggagaatcgcttgaacccggcaggcagagattgcagtgagccgggattgtgccactgcactccagcccgggcgacagagcgagactccgtctcaaaaaaaaaaaaaagaaagataatggatttggttctgccattagatctgggttggatcctgggtctgctatggtttctgtatccttagtccagtttcttaatttcttgagtcgtcagttgctccgtttataaaatggtgttcagtgatacctgtgtttttagcttctcaggcttgttgtgaggtgaacatataatgtttcatgtaaagcaccttttagatggtaaagcgctatgcagaactgttcttaactattacttctcccatttaaaaaatttgctatctttctgattcttttaagaattctgtgctttccctgtctcattcccctccgataaactggagaaaaaagggcttagaatgatcacccatttttttacctaaccacttttcctgcatttacacatttttttttaaaagagaagaaataacatttttttaagagaaaaaagtcccagagagattaacttcttcaaggtcatagagctggtgacaaaatcaacagacctttgatttagttcattcatatctgtaactttatacatatttctacttaactaattttggcatattttacgcttttttttttttttttttaaaggacagggcctaacatgcccaggctggagtgcagtggtgcaattatggcttactgcagcctccagctcctgggctcaaacaatcctcccacttgagtctccgtagtagctgggactacaggcatgtgtcaccacacctggataatttcttaaatttttttgtagagacgggatctcgttatgttgtctaggctggtctagaactgttggcctcaaatgatcctcctgccttggtctcccaaagtgctggctcatgcctgtaatcctagcactttgggaggccagggtgggcggatttgcttgagcccaggagttccagaccagggggcaacgtggtgaaacccatctctaaaaacaatacaaaaattaaccaggcatggtggcacatgtctgtagtcccagcttcttgaggggctgaggtgggaggatcgcttgagcctgggaggtagaggttgcagtgagctgtgattgcaccactgcacttcatccagcctgggtgacagcgagagcctgtctcaaaaaaaaaaaaaaaaaagtgctgggattacaggtatgagccatcgcactgggcctctgccatttttgagaatatgcttgaacattcgagactttcttctcccttttgcttctgtcattctacatgttggcttatctgacattctagtttaaatttttctcctacctaattttcttaaatgttctttatccatctgtctttcctctgatactatttaaagccgtttgccctgaagtaggcctaccctctcttgtttctttagtaggagctgtcttcccactctgtgtttctgagtgacagtttactcctgttttcctttcccttttctctcccatcaggcttgaaatctttgttcttcttccatgttttctgaagcctgtgcctttctgatatgcctttggattgatgttgtcagcttagttgtttttgtttaatttttcactttaggcctttaaagctaccccaactatttcagtctcccttttattctagcacattcttgggcagtttctttttcttagattttacttctgtgcttacattccaccttcttttccactgtgccctcgtttccacacttggaacattgtctgtgactacatgatggcattcagataatttactaagtccattttcagagcttgtctttgccttttatttcagctaaatctcttctaaaaaaaaattgatatagatggttaaccaaaatcttctcttacaacagtttatttcatgccttatttcgtagtcaaaactcaacttttctgccacctttgtacttcataatcacatttttccataaccaattcagaattagtttcatttctgaagagcttggacagtgtctgttgacttgagatccccataaagttttcatgagtttggaattctcttttttcttattcagtgttccaggtcccatttctttaccaaagcaaaatacgtgtactctttaccctttgttatattttctgagtcctgttttgatactattttcactcatttgttcattcaacaaatgttgagtaccctgcacatacaggccctgttctaggagctagggtgtcctgaataacaacaaaaagccccccttctcatggaccttatcttctagttggaggaagtgtggggtggggagggacagtcaataaacagatgtacaagtaatacatggcacgttaggtggtaaatattaagatggagaataagataaggacagagtgactagggagtactcttttagataagattggtaaaataaggtgacatttaaatagtgacttgaatgaagtgggaaattagttatgtggatatgtggaagaggagcattttcaggaatggtattaaatagcaaatacagaggccctaacttgaaatgtgtttggtgtgttcagaaaacagcaagcacggcactttgggaggtcgaggtgggcggatcacttgaggtcaggagttcgagaccagcctggccaacatggtgaaacctcacctctactaaaaatacaaaaattagccaggcgtgatgacatccgcctgtagtcccagctactctggaggctgaggcaggagaattacttgaacccaggaggtggagcttgcagtgagccaagatgatgccaccgcactccaacctgggcagcagcgtgagactctgtctcaaaaaaagaaacagaaaacagcaaggaaaccactgtggttttagtggaaggagtaaaggatatgtgattgatgtagtaggataggaaatgagatcagtttgtgtaggatatattctggatatattttgaaagtagaatcaaatgagatttgctgatacattagatgtggggtatgaaagaatggaagagtcatgaatgacttaaagggttttggcttgagcgattggaaggaaattattgttttattttgacctaagtcttctgcttttcttctcttgcccccactttttcagtgttgccatttatgatagcttgctgacacttacttcccagccaagcaacaagaaaaaagttatatgttctatattttcacattccttcaaattggctgtgctagctactactactgttgaccttctagccccatcctttcttctctagaggttttaaggtttctctgtgcagtatgcttgtatcagctctaccagtggaaccgccttcaggaattattgcaggaaaccttgcaacacttttagtgttgtctataagtatgtctgtgcttccttgcatgaaccactcattcaagatggcttgtgaatccacgtaaaaagaaatatacgaagtttgaactttaggggaacattagagaaaattgaatggttcaacataagggaagcatagatttagattcaatgtcaaaatgaagtcagaaataaaacatcttcatttaaacctactgttgaaaataaaactgttacagaaaattgggaagaatggaattaccgtaaaatatcaaaaatagttccactgacttatcaatacatgactgtatgatacacatgactatatgatagcttcctaaagtagtgaagaagaagaaagttactgatagcttagggactgtattggatgatctgtgaagatatcagtgttgtatgagcctttcatccctttgatgtggagcctggcattggaattgcaaataaaagtaccaaatataaaataatactggtactattaaaattagaatatactatccaggccttttttttttttttttttttttttttttttttttttttgagatggagtctcactctgtcacccaggctgtagtgcaatggcgtggtcttggttcactgcaacctctgcctgcaacctctgccttctgggttcaagtgattctcctccctcagcctcctgagtagctgggactacaggtgcccaccaccacacctggctaatttttttgtatgtttagtagagacagggtttcattatgttggccgggctgatcttgaactcctgacctcgtgatccgcccacctaggcctcccaaagtgctgggattacaggcatgagccactgtgcccggcctactatccaggacttttgagcataggaagccttgcttttgattctaaagtgagagagggtcacaaaagtatgggtaaacattagattgtcaggtatgaaataatttttaaaaattaaaaccagaaacatgaaacatgaactccagaacccaggaagctgtaatctcatctcaattcagtttaaggctaatttttatgtaataacaccttaataggaaatgtcaaatctaagaagtaaattgaaaaggactaatcataagtttggggaataaaaagattgaccattgtgtttgtctgttttcacactgctgtgaagacctgagactgggtaatttataaagaaaagcagtttaattgactcacagttccacatggctggggaggcctcaggaaacttacaattatggcagaaggcaaaagggaagcaaggcatgtcttacgtgacagaaggaggcggggagaattgtcaaacacttttaacataagatctcatgagaactcactatcatgagaacagcatgagggaaactgtcaccatgatccagtcacctcccaccaggtccctcccctgacaatggggattataattcaatatgagatttgggtgaggagacagagccaaaccatattaaccatctctctgaattttttcttattaatattgatatttccaattttcctctataaatggtgactaggagcttggcttctatagttttgttatataattaccctttaattctatctcaaggcatattttacctgtgtgatgtcttctaccaatttctgttaggtctactctgaaatggatgccttgaaaattgctttttagctaaaaaatttagtgattccccgccccccaccccttagaccagatatttttactgctgcaatagctctattaaccaccccacctttaaaatctttggctacccatttactagcctgggtcttatcctttcagttgttttttcttatatttttcagttttctttttttcctcaacttacaatggtagttttttttcctaaagttcagttcactttctgttcatgactgtcagaagatgtgtatgtagaaggaacttgaacatctatatttctagatttttcttcttagtttgtagtagtcatttattgctacataacagattactccaaagtttagcagcttaaaacaacacacatttgttatgtcatactttctgtagacaaggaattgggcacagtctagctacatcttctgcctcactatttctcacaggctgcagtcaggacattggtcagggtgtgtggtctccttctaaggcttgaatggggagggatctgcttctagcctcactcagtggttattggcaccattaagttcttggcaggttgttggactgagggcttcagtttcttgccacgtgggcttccctaacatgacagctttcttcaataaagtatgcaagccaaaaaggcaatagtgtctgctggcaagactgaagtcccagtcttgtaatctgatgatggaagtgacatcccatcacttgtgctgtattcttttgcaagaagcaagtcattaggtgactttccattccatatgtgtgaggaatcatacaagaatataaataccagttcttacgtcagttcttccttggcagtgtctgccccttaaatgttactattctttatgatctgtggtttgtcttctctttttttccctctagtctacactttttttccccctgggttatcttatgcgctcatggaagcacaagttcttaaactagtttgcctgtgttgaagctcttctgctacttaattgctctctgattttagacacattttctaacctaaagcattaatttcctcatcagtatgataggagttaataacagtacttaatccaataggtctatttgaggacaggtgagaaaataaagaaatactcaacagataatcagtgctcaattagtattagctgtaactgtaacaaataatagtaataacaacaatcatgacttcagctattaggatttgttaaagattccttcgtctgtctcttactttggcatctgtagaggactgacagacatttctacctgaattttctggaagtattgcaaactcaatgtgattaagactgaagtttcctcttgttggaaggaatgaggattggtaagcctgtctgatgggggagatggaggaacagatttaaaattgatcctgtgaacttcatttagttattcaacagctatttactgagtgtctgatctgtgttaggcactgaaggtaccacagtgcccaggtcaaagtaattctctctgcctttctggagtcttaactgtgtgagggaaatacaatgttgaacctgtaattcccagtgctatgtttatgagatggaagtacaggatcctattgggatcacacaagaggagacctaacttggtctgcaggccaggagaggtttttttttgtttttttttttttttaagaaattaggctaagacttctaaaggttaagttggagttaagtctattgaaagtctccaagtctggaaacagcatgatgttttagaagaacatactttcctttatcagtttgaaaattttgcttatttaaaactaatttcctattagtctcttgttcctcattcccatttacactcttcattgctgtcctggattattacaaaagcctgtttgtttgttttttttctttttgtatctttctagttcattctgtccattgctacttttttataaagaacatttcactaccatatactttctgttccagccacaggaacctgtttgcaggtccctgaacctaccttcattttctagtgctgtgcatttcctcatttctttcgtttggaaagtggtgagaaggtcctctaacttgcttcttgccctcatttctctaagcagagctacaactttgtcctgtctgttcctctggcacttcccatcaccgtgatagcatacttcactgtggctggtttccattcccatttcctctactatagtgagccacttgaggcgagaacccttgtatttccaacattggtgtactcagcatcttgcgtcgaggactcagtaagtattatatttgaattcccactgcaccgctctaattagaattttaaaaatcactttctatctggattgttacacactttttttccccttaattcatttttctccatgtactacccatatgcatcctatataaatttaccaacactcataaaaatcttactcagaaatcttcagaggtttgctaaggatacaatttgattcttacacatttaatgctcaccagctgcttaggcccacaccatttatccaccctgatttgctactgctctttgaaatacaaccagtgtttcagccagactgttttcctgcttctgctccccttctcctcctcccagcacatctgtgaattctttgactggtttaccactcccacactcctccccagcaatgcagatcttctacaccctttaggatctaagctaagtctgcttcccagatatcctcccgaactctgaatgtcctttgatctctcttttctcaaaaaccttttataccttttattcccaaattatcttctctagaaatctgtaagggcaggggaaggaaaggttttatactattctgtcttcggcagaggacttttattattgcttgttacgtacagtattagtcatatcttgctaacactcagtgaactgccctcagctgatcctctgccctgtacctcacctctgctttaccacctttccatccgatttctaaaactgtagtgggactttttaaaaagtgtgtgagagttttaatcctgttgtggtaaactcgcctttctttgcttgctatactgtttctagtccctattttccagataaaaatagcccaggtcagcatggcttgcactatttttaactccaggtactaggagaaaggtttgctctaaaggtgaaatgaagttttatgacgttgcttaggccaaaagtcagttgatgaggttatgaactgcaatagaactttacacatccatgaatctaatggagagggcctgcatatcttatgtccctcacccctaccaatggtgtgtgaatccttcaaaacaaaacagcataatagacataatgttgaaagtgacttctttatataccctttttataagacctagaagaaaaaagcttgtagctagaaagcagatgcaaagttcaacattgataccacgttgatgtgcagagtaaaattttcaagagcaaaattttaagcttctaaaattatcatggatttgatttggttttcgaactgtaatttactcaaaatgtcaattacgtggaaggaggtttaagagttgtatttaacaaaagagggcatgagttaattaagttgagaaatatttcttttatgatgagaaaaccttttggccttaaccacatttctagattcaaggatttaatcaacgtgggagaagcagttgctttaactagattaaaagagggccatggtggagtgtagataaatagaaatctggcagtgtaaaggtcatttgaatctggttttctcacacattcaaacatttttatccttaaaacaaaaatggcagtttgacctgccagttttgcttagttttgatgcttaaaatgtatttttattctctgattacagagttggtaaggaaagtagcctaagaaatatttaccacagatgatttatgtgcaaagagtggttgtagttttgggtggttacaacccaaagtattttggaataaaatgtcttgaataaagaaattttgggctaaaggtcatgtgtgataataaaataacacccttttccgatagcttagaagttttttccaaggcggtcatataagctagcgtctcacaactttgttttgctgctggacccctttcagaatctagtgggagcggtgcactttctcacactcaaaatgaacatagtacacacaatgttctgcttgtaataaagcccctccatagaccctatgttaaaaaccccgttagagttccaaaaaaccataccaaaactaaacatttttaagcatttcatatcacgttatggtagaataaggtttctgtgtgtgttcagttcttgctccctccctgcctttagaactatggtttgagtttcttttcccccataaataatggtatgtatatcctatggacttctggaagatatatgccttatacagtctggctatagaacaaaacaaagttaaccggtatataccaggatggaaactaccatatagtgataatgtcttctctggagggcatacctctccagacacatttgctaggttaattcttgctttagaattctagatgtgcagttgtaccataaaagactgagagtctttatcactaataattaacactggcttatgattctctttttcctcttgtccttttaaccctgtcctgtcccctgctcccactgcctctgttctcgtttgttttgcatttttgtttttccttgtaactggcatttcagtagtattaacctgaaattttttttttttttgagacggagtctctctggctctgtcgcccaggctggactgcagtggtgcaatcttggctcactgcaagttccgcctcccgggttcatgccattctcctgcctcagcctacctgaattaaaaaaaaaaaaaaaaaaagccttagtaatagtagtgctccgcggctggggaattgggtgggggtggggggtggggggtgcttactaactaaaatgaaactagaattcatactagtttttttatattaaaatagtttctataatggttagatctgaaacatctctggatagttttggtagaaagtatctgcagaatatggaagaataatttgttcgtattgacaattttcaggaactatgctttgatgttgcatagtagctgtaagctttttctttaatgtgtgcctactctagagattcttggtgtttcttcctcttagaattgtctggggaaagggagaacagtagtgtggggtggggaagatgtttgtggacagaagccaggaatgggaataggacctgctagtattgccttggattcttgtcatctggctctctactactgagcaaggcactcaacaactctgccagtctctccatctatgaaatgggagtaatgctgacctaattaacagaagagttgttgagtagatgattatttgtaaaagactttttaaaaaagtagttatattggctgggcatggtggctcacacctgtaatcccagcgctttgggaggctgaggtgggcggatcacgaggtcaggagatcgagaccatcctggctaacatggtaaaaccctgtctctactaaaaatacaaaaaaagccgggcatggtggcgggcacctgtagcctgtagtcccagctactcaggagactgaggcaggagaatggcgtgaacccgggaggcggagcttgcagtgaggccagatagcgccaccgcactccagcctgggcgacagaacaagactccgtctcaaaaaaataataaatataaataaaataaaaagtagttttatttctcagcagtgccttttcagattaggacttggtcttagttgcccttaactctgttcttggtgttggttaacattgtcatcagaagttcagattcaattttagattcagaattcttgacttggttttactgggatgtcagaaccttatttttaattaaagcgaatctattgttgcttaggcagttggcacatagatttggcactgtgagaaaggaaatagtgttcagttgataagggcatcttgaactgaatttcagatagttgtgttacttaatgggtaatgaaataactccagctgaggaacaccttgattaaaaaatctttctctcctcatgccttctccgttagcagattgaagtcaagtggcaatattttatttataatcatgaatttaattatttaagctatattaaaaaaattgaaacccttagatgttaattaattttaaaaactagtgatggatgcaggtaagctagaatgattggatcaaatctcacacacaaatgagtttattctttaaaaaaaaattttttttttagagacggggtcttgctatgttgcccaggatggtcttgaactcatgacctcaagcaatcctcctgcctcaccctcctgaatagctgggattacaggcatgagccactgtgcctggccttattttacaggtcttactgacgtaagcccatatttgatttgttttacagtttgttgatattgcttagtatttcttttatttactgtatagtctataacttaataggtagcagtaaaaacaaaataataaaagttatttattttcctcctaaaataatggggggtatttatggcttatttacccttaataatgtcttttaagtggccattataaaatatgtagaattactttggtgtctgtgctgtcaaatttggctcatgtagtaattgtgctcgtagtaaaaagtgtattttaagcagcctgtgttgtccttaagaaatttcatgtaggttccacacttttttctaaaattaattattcttaacatttttaacagtcaaaacttgaaaccattaagatgtgaactgctgtatgtattataatagggagtagcttttttagtgttgacattgtataaaattagttatttacaaagatagtaaagcttattgtttgaaaataaggaattgaggaaatgaagttaaacaacatgtattcatacctatgtttttcttatagaaatatataatatctaggtatgtagaaatgtaaacactttgaattatacaatactttgaataatttaataacaatatagcttaaatacttgtagtgttatcttttcagtttgggaattgcatatatattttaactgtaaaaatctttttttttttttttttttttttttgagatggagtctggctctgttgaccatgctggagtgcagtggctcactgcaacctccacctcttcccaggttcaagcgattctcctgcctcagcctcccaagtagctgagtgccaagtacaggcacgcaccactgggcctggctaatttttgtatttttagtagagacagggtttcgccatgttagccaggctggtcttgaactcccaacctcaggtgatccacctcccttggcctctgaaagttctgggatagcaagcatgagccactgcacccagcctgtaaaaatcttacatgtcatgggaaagaggctgctgctttgtttatgactttatatagtttctgattataaaaataatacagtgctccaaagtagatgaagcaaaatctgatagaaatgaaaggcacaatcaacaaattacaattatagctggaaatttcaatacttctttctcagtaattcttaaataggaaatcaacaaggatataaaagattctaacactatcaaccaatttgacctgattgacatctgtagaatattccttgcattaacagcataaaatacgttatttgcaagtacatatgagacatttaccaaggtacaacaggtgctaggccataaagcaggtcttaataacttaaggattgaaatcatacagagtatattctctaaccactatgaaattaaattagaaatcagtaataaaatgaaattttgaaaatctcatatgtggaaattaaacagcgaatttctaaataacctatgggtcaaagaagaaatagatgtagagcaatggtacagggtgaagagttcagaaatagacctacactaacaatatcaattgattttttttttttaataaagatactaaggaaattcagtactggctaggtttttgttcttttttttttcttctgtaaatggttttggaatacatggctatctatgtggaaaaaataaaccttgacccttatgtcccaccatttataaaaattaattcaaaatggatcactgacctaaatgtaagacctaggctgtgtgcagtggctcatgcttgtaatcccagaactttgggaggccgaggccggcagatcacttgaggtcaggggttccagaccagcctggccaacatggtgaaaccctgtctctactaaaaatacaaaaattagttggatgtggtggcgtgcacctgtaatcccagctactcgggagggtgaagcaggagaatggcttgaacctgggaggcagaggttgcaatgagctgagatcgcaccactgcacttcagtctcagtgacagagtgagactccatctcaaaaaaaaaaaaaaagtaagacctaaatccataaaactttaaaagaaaacatcagagaaaaatccttgtgacctcaagataagcaaatattttttaggacataaaaaagatgagccataaaagaaaaacactgataaattagaccatgtcaacattaaaacgttttgcttatccaaagataccattaagaaaatgaaaagacaaacccttttgagagaaaatatttacaagcatattcaacagaagacttgtatcagaatgtctaaagaatgtattaataagaagaagagaaacaacccaaaagaaaaataggcagaaaaattgaacagctttttcacaaaagaagatacaggaatggccaagtgcatgaaaagattctcaacatcattggttaccagaaaaattaaaaattaaaaccacaatgagatgccactatacatacactagaatggctaaaattaaatatattgatgataccaagttttggcaaggacatggaacatgtgcaatcctcatacattcattacttgtggaaatacaaaatggtacagccactttggaaaacgggttagccatttctcataaagttaagtataaatttatcatatgacccaggaattccactcctaagtatctatcaagagaagtgaaaacacgttcatacaaagacttgaatatttttattcattatcaccaaaaataggaaacaacccaaatgtccatcatctggtgagtaaacagagtgtgcttcatcatacaatgagatactatttagcagtaaaatgaagtgaactagtcttttatgcagcaacttcagatgaatctcagaaacatcatgctgagttaaaaattgtaacataaattatttagctcttcatggttgaagtttgtactatttgtaatttttttctgtcacaaataatctgatgccaacaatgcattagatattcttaaagatgtatctctgtacattttaacaaggtttttgtaagaaaaatttctagactataattgctgggctagtgaacatttttatttgcttatattgccaacatttattgaatgcttattgtgtaccaagcactattaggtgctctttctacccagattacctcatttaattatcatagcaaccatatgaggtgcaggtcattactattttcctcattctataattgaggtaactgaggcacagagagatttaaaaacttgttccaaatcacacagctagaaagttaggtaaaccaggatagtttgattctagagcttaacttcctagctaagacatgtgaagttaagtttctatgcatcttttgaggggtgttgtatttattttcaggtctcctacttgatctcactgtatgcattacagaaatttcttgtttatttatttgtttattttgagatagggtctcactctgttgcccaggctggagtgcagaggctcgatctcttagctcattgcaacttccaccttctgggctgaaatgatcctcccatctcagctcctgagtagctgtgaatccagatgtgcaccagcatgcctggctaatttttgtattatttgtagagatggggtttcaccatgttgcccaggctggtcttgaactcctgacctcaagcaatctacccgcctcagcttcccaaagtgctgggattacaggcgtgagccaccagacatggcctctcaattttaaaaggttaggatgagccaaatatttattaaatgagtctttcccttattgaagtaatttcagaaatgcaccattggaatgttgtttaatttcaacaggtacaaactcacactcaaggaaaaacccagccattcactcaaaggaacattattttgatagtattcagatatcgtatacaaatcttttgagcaggttagttttttcatgtaaatcataacatatggtattggtcaagtagtaaagttcatattaaccttaaacatttactaagatactgttttcaagtaactcaggcaatgtatgcagagggtgtcatagtttctgtaagtatataagttttggatcaagatcacattaatgccagggccccactacagatcttctgaatcagagattctgaatctgaggtgaagactcatagctccttaaaattccatggagaaaatatatatatacctactattttcccacgaaaataaaaaatttaaagacaatttcctggagattctaattcacatttgggtctgagaattcttgtgtagggcatactctccattgttaaaggatactaaaaagttacatcctatatctcagatacccaaaggacatttattaagtcttatatacacctctcacaacctataagcttgcaaagcaaaaaggccttctaataccccaaattggtttatattttcttgatagttttaaccctatagattaatattctcttacctttttccccaaggcttctaaaagtagatgatactatctgtctttatgtgatagttgcttgtttgttaacttctttatgacatgtgccttcaagtgatgttctaaaactaaacttttgaaagttgttattccccttgtaaaagggtctgcccttttccctctcctgtgtttttctccttaaccatttcgtagtgcccacaggtagcgtggtatatattggtcaagaatgtaggatgcaaaggggggttgcctagatttaaaacccagctctgccattggctggttgtatgatgctagcaagttatctgccttctcatatttatttcatgggatagtaatagtacttatgtcatgattattgagagaagtaaatgagctaatatatgtaaagcactgtacctggcacatagccattaaaattaccacctgcttctactcgcctctcccctgttggctttattctcctctgttggcttacatgatactgtactgccatggctttctgtgatctcttgaaccattccttctttgctggtttcctttcttctcactaactataaatagtatttctctctggttttggtgtcaacattcttctctatatgtaataaggattataggcctgtcaggtagactggggtttgaattctacccctgccacatattagctgtatgaccttggaattttaaatttcctcaatcctttccaaacttagatttctaatctgtaaaataggggtaattcctttatagcaggattgttgggaggattagagataatataaagtgcccagtatagggtctgaaacactgtagttgctgagtaatgggatctgctgctcctgctgtcttttctagcttattgatctcatccacttctgtatcttcagataccgtcactgaactgttgatgcctaactctatttctctagttagatttccttcttgcactgttaaggtgtatttcaaactgccattaaatgttttctgtatgtcttattggcattttagagttttcacacttaatatcagactaatcctaccctattatcttccttctgaaacctgctgtttatcatgtgttccatatttttactcatgttcttgatctccttttaggcatggtaccttagcattgaattgattcattcattgtctttgagtctgtttctggttcctctctgcgttctcacaccaaggctcaaatatccatcttttgcttcagttctcactactatagttaaaccctcactttatcgtgtgtgtattttttcccccagtagccgtgaatgtcatctccctacctccattattctttgttttccccaatctgttctttacattcatctttctctcttatcagatccatcttcccagagtggatattaggagattctttaccccaaagagtcaaatagtagatagtttgggctttgtgagccttgccgtccttgttgcaactgtttaactctgctgttgtaacaggaaagcagccatagaaatacgtgaccacgtaagtgtgactgtgttccaataaaactttatttacaaaaatgggtggtggtctgggcatggtggtatgcacctatagtcccagctacttgggaggctgaggcagaagaattgctttatcccaggagttcaaagccagcctggacaacataatgtgacccccatctctttaaaaaaaagaaaaagatgttggactagacttggcccacaggccatagtttgctgacccttcccttcctacctttctttctttctttccttttaaattaccattccttctagtatttcttgaactaattatctttttgagatattgactgcaaggtagaatgaacttttagctccctattttcctactgtcatctaaaatatttcggttttaagtgttttggttctcatcatttggagaagtacaaattatgcaattacaaagattccagaaataattctcatagcatttgccctgaatagtagttcctgactctttcttagatgctactaggtgcatgtgttatcaatacagtcctatatactgtggttctttggggaggtagctttaggtctgatgggcttatcagtttcttcagaacctgctttgacctctgtgtagtagtattccatttcatctgtcttatctcagcctttcagatttcactgactgatgaaggaacatttctatttggcccctgtatatttctccttagggtttaggtgcattctgtatcagctttgtggacactttccttatgtgcccttggagatcttcttgcaacattctaatttattaagttaaatatttttgaataccttctgtagaactgtgctgaagacataaagacaaaacacagttctagccttaacaatcctcatgttttgatgcaggggtcaggtgactcccaaagggccagatcataaatattttaggctgtgggctacatggtctctgttgcaactactcaactctgctattgtaatttgaaagtagccatagacagtagattgagcttgactgtgttccagtaaaattttatttacaaaaatcagtggtaggccatatttggcctgcaggctatagtttgtcaatccctggtctagtggcattgtgccaagggatatttgaagccacaggtaaccagtgtgtcttccttgaacgtaattttactcagttattgtggagaaaaagttaagtagtttgatttatattgatttaaaacattcttttaataacataagtggccacccaaggaatagaatataaaatcaagatgactatttaaaatgaaacagccttgcaagaaatgtcttgtttgtagcgaacctcttagatctgtaactacaaactcttctgccatttgttggataagcttgagaagcactgctaggcattgggagctatggaaggatttagaggagggcagtgacatcagattttaattttagaaaactaacttgaatggagtgtggagaatagtttggagaagggcatggcaattctggagggagggagatagataagaagactgttaacaggaattgaagcaaaagataagagcttcttttaagatgtaggtattggaggtagagagagttatacagattagagacatagcaagaaggtttgatttgattgattgtgtagggcaagggaaatggagaaggatgagtcaaggatgatagttctaagtttccgtagggagactggttgaacaaggatgccactcagtaaaggaaataatacatgaagaagagtaatgtgaaggccagggaagacagacaaataaattgctttggaactgttaagtttgctttgcttgtggacatccagatggaaattggttttatatgacttaaggctctggagagcaacctcgacttactggggtgggcatgagattgaatgtaattctccagaggaaaagttgtctatagcaagggtatttgctcatgacagaagccaatgaggggccgggctcggtggctcacacctgtaatcccagcactttgggaggctgagggaggtggatctcaaggccaaaagatcgagaccatcctggccaacatggtgaaaccccgtctctactaaaagtacaaaaattagctgggcttggtggcgcgtgcctgtggtcccagctgcttgggaggctgaggcaggagaatcgcttgaacctaggaggcagaggttgcagtgagccgagatcctgccactgcattccagcctggcaacagagcgagactccccaatctcaaaaaagaaaaaaaaaaaaagaagccagtgaggaaaaaacaaaaactgcctgggtcagtagaggaagggggtggggatgtgtattgaaagaaaaggaagaaaaccagaagacgggggtgttttagagaccaagaaataatagaggttcaagaagatgaatagtaccaaacactatagagagggttaattaggattggaactaaaagacatttattgccttttttttttttctttttaaaggagtggggtaatttgggacttttcctggggtaatttcactggagttgtgggagcaaagtcagaaagcggtgcgttgggtgtgagtggtatgtgagaaaacgtaagcagggaccttagaccagcacttctggtctacattaatgtgtctatgagtcactgggagatcacttggagatcttgttaaagtggagattctgaatcagtaggtctggcatggatgcccagattctacatttccaacaacctcccaagcaatggggatgctgccgttctgacagccacctgaactcagtatcccaaattgttcatcgatgtatcccagagcactgtagctaacttgcaagggtgccatggaatatttttaaatttcaagggaaatacactggcgtcattagattgctgtattagatcactgcattcctttcagtgatgtcatacctttgggaagctggattttcagtgcttgctctgataaaaagcaagtactgcctgaaaatcagtgtggaacaggaaatgaggctgtcagtgttcaatctgagtccagagtttgaaaagtatgcagtgcccaacaggcatccagtttttagaacttaaaatacttactaagtggtttggctcttactgcttaacggaggcaactacagttgttagatacttcttttggccgaggtttaccctgcaagatcactgagacactaaagattctttgagccaagaaagtttggaaccgttgacataggacttcttcatagaaacttgtctgtggagccaaagagagcctagatgattgggcggtagctaaaagaggaacaaaggagcatttattttaaaataaaagagacagatatgttgtatgttgggggagggagcagctgataaagaagcaacaaatgttgacttagagtaaaagatctctgaggaggtgagaaaggatggaatctgttttctctaaatattgctcccaaaccaacactggtttgttggaagacatgaagaacgttattccccactccagacctcctgaatcagaatatgcattttaacactatccctaggtgatttgtatgcatattaaaatttcagaggcactataggaggcaggattggccttatataggagaaagaatgtctcttccttttatttattccatcactatattgtgtactttcccgcatcctagccattctgattgagggaaatgagatgacaagggttatttatttagataaatttagaaatctgggggtgaaaagttgaggaagtttttgcttgtttgccttaattatctcaggtaagtacatagaaaatatctccatctagtgaataagaaaattgggactggccaggcgtggtggcttatgcatgtaatcccagcacttggggaggctgaggcaggtggattatgaggtcaggaaatcgagaccatcctggctaacacggtgaaaccccgtctctactaaaaatacaaaaaaaaaaaaaaaaattagtcgggcgtggtggcgggcgcctgtagtcccagctactcgggaggctgaggcaggagaatggcgtgaacctgggaggtggagcttgcagtgagccgagattgcgccactgcactccaacctgggcaacagagcgagactccgtctcaaaaaaaaaaaaaaggaaaattgggactaaaataatggctgagagaggtgagcaatggagatttgaaataaccattttgaggaacatcaacaaacctgaccagaaatacagaaattgccaaggagttctgaaggtccaggtgaggtcagagacaacttttagtggtgtcaatctgcataattataactttttccagtggtgctagtagcttgggtgtgggaactgcaataaattggattagtctacgtttgttgatttgcagcttgaggttaatgaaaaaataagctagcaaaaatctatcctgaatatgaaaagaaatgaagccacaaggaggatgagatgagaaaaaggagtagaaggattggagttctccttgcaagccaatgaaaaggctacatatcctgaagttggaagaatcctgcccttgtttttatccacagggagaggaaaattctttcctgtcaggctgcagatatttaacagggctttgtgactgattagataacaggaaagaagtttcagtctaggatgactcctactgttctgatattaaaacctactgggaacatagttaataattgatgataaattggcctccagtgagcatttttttttctgaaagggaaaggcagagggtgtgatgaggaagcatggaggcaggatgagatttggaaatgttgaatttgaggttggataggagagtatgtaggtaaagatggctgtttataccactggaaacagggacatggaatataagaggtcagatacaaagatcagcttgggattcagtgatataataatagcctctattgattgttcattgttatgaagaagactgagcagtttatattgtcatttatcctctcatcaaccctttgaggcaggtattaagccattttacagatgaagaagtaggattagacacatgcccagggccacgcagctagtaattgttagaaacaagattaggaactagatctctccgattccaaatccatgcccttctaagctctactatattttaggtcaccagcttctggctcttgattgatacctgacgtgttatagagcttctcagatgcaaataaccgaaacaaaacaaaaatctttcaaatgagcttaagcaaaccagaacaaaatgtattggtccttacctatgggtctgctgattgactggcagagttggaaccaagggctcaaacaatattatcaaaacttgatctctcagcttttcttttctatattagttattctcttgtaagctccctgatatgacaacaagatggccctaatagtttcagcattacatcatggagatacatacagaaagagagctgctctttaccaagggctttgacaaaaatcctggagttgcctctgattggcttaggccctttgcccatttctgaaccaacttctggccaggcttgagccacatgtccaccctggagggtagagagtgaacctcacctaggggtgagaactgaggactacaggtcaggctttcccaagtaaatgaggcacctggaaagagaagaaggggaatggatgccaggcaaacaaaagctgcttgtccacacgtggacagggatgaaaaatctcacctgtgactgcttgaggatgaagataaagattatgagactgtcagtaatgatgaaaataagtgacatttgttagatgcttactaggtaccaggtgctatgctagtcttttacatgtattctattgtttatcctcaccataggtttttgaagtgtatactgtcattatttccaaatacagctaggaagtggtagagctgagatttgaattcaggctggacagctccatacctcaccctctctattaccaccataacattttacttgtaattttctcattgtagttttcacattttgtctagttacactggttgacagcatatagtgaatcagacagacctgggccaccaatttttctacatagtatgcttaataaataattgttaatatgacttaaatagcatttactttaagtattatagtggaaaatttttaaaattaagttcttagtttttctcttaaaatgttttgtgctttatttatttttattttattttattttattttttgagacagagtctcgctctgtcgcccaggctggagtgcagtggcgcgatctcggctaactgcaagctccacctcccaggttcacgccattctcctgcctcagcctcccaagtagctgggactacaggcgcccaccaccacatccggctaattttttgtatttttagtagagacggagtttcaccatgttagccaggatggtcttgatctcctgacctcgtgatccgcccgcctaggcctcccaaagcgctgggattacaggcgtgagccaccgcgcccagcctgtgctttatattttaatcttataagtggctttttatgtttagccactctggtcctagaactcttttgtttttttaaacttcttataccatacttgaatatgtaaaattctagttggattatttcatttttagtatatctgtagagattatggaaatatttttgttaatctttgtttagtctttgtaataatagtttcaaaatcttatctagtatttctataaacgcttttttataaaaagctaatagtgtgtttttaaggcttgtattttcaaaataatttattctgaggttgtcctgtttacttattcaaattggttattcacaaaaataaaaagatagtctcatgtgctcttatttttaagatgcgtattttaagcattaaaaccatatgttttgtaacagagtttgagtttttagactaataaaagttaccgagtaccattttattttggttttcatgatttggggctctgcggtgccaattatatttttttaatcctgtctgaaatgtctgatctgtgtcgtcataaaggaagcagtgcaggattggaaatcaggagacccctttttgtcctttgggattcccctctctaaagagtttgggccagacctttatgatcttttccacttttaaaattctagtgtttttattttaaatctctgctagatcagaagcactgccttatggatgtatagtcttagagctagattggaagatagcatagtccaggttccttattttaaagatataccagctgggcatggtggctcacacctgtaatcccaggacttggggaggccaagatgggaggatcacttgagcccatgagtttgagaccagcctgggcaacagaatgagttccctgtctcacacacacacacacacacacacacacacacacacacacacaaaaaaaaaacagaatgagttccctgtctcacacacacacgcgtcggtcgtggtgaatcagttcctgtctacacgcacactagccgggcatggtggcttgcgtctgtagtcccagctactcaggagactggggcaggagtattgcttgagctcaggagtttgacgttgcggtgagctatgatcacgccactgatctccagcctgggggacagagaccttgtctcttaaaaaaaaaaaaaattaataatagtaaagataatccaggcccaaatgatagcgtctaagatctcaccatcatttagaagtagtggagcaaggacaggcatttctgcctgtgctgccttatgctcttctttcctcaaaacggtattagcaacttgaagacagacaacattcatttatttgattaaaggaacatttattgaatcgcttcaatctatcaggcattttactaggcatgtggttagctgcaaagatgtgtacatgagggaatgtgcatatatggaggcccaaaactggaatatagagtccaacaaccttgggttcacagtctatctgaccacttaggagcatgacctcagttaagttagccattctaagccgcatttctttgtctacaaaatgagaataatagtagtagacatttacacagttgtggtgaggattgagactataaagattaaacttagcatagtacgtggcacatagtagactctcttagagtttatgaaagaaggaaggaattaagacttatggaacattttcctgtattgtcttatttgattcatacccctgtgaggtagatagtgataccctaatttttcaagtgaggaaacagcgctgaaggcttgggacttccccaaggtccacagccattagtcatacctaccatacacattatttttaaaaagtgcaccagacactgttttaagcatttttatgtactagtttattagctttgcatgtggtatactattgttattttcacttaacagacaagggtagttaggtacagagaagttgaataatttgcccaaagtaacacagtcagtaagtggcagagtcgtgtgcttcatgtgcaggaaatctggcttcagagtcccactgttcttttgttgttgttgttgtttgtttgtttgtttgttttcagagagcatcttgctgtattgccaggctggagtacagtggcgctatctcagttcactgcaacctctgcctcccgggttcaagtgatcctcctgcctcagcctcccaagtagctggggctacaggcgcttgccaccacacccagctgattttttgtatttgtagtagagatggggtttcaccatgttgggcaggatggtctcaatctcttgacctcgtgacccgcctgcctcggccccccaaagtgctgggattacaggcgtgagccaccgcacccggtcagagccccactgttcttaatctttgtgttcttccttttacttcatgctctcttttgtgaaggtgaaaagcagttttacaaactagaaggtgctacataagatgtggtatatttatctgacttggtccctgtactccagagattacagtccatgaggaatgtgtcttctccaggctaaacctactcatttattgccactgttactcgctggatattgctgtcactattttggccacttttctttaaaaaaaaattttttttcattttgtcaacgttcgccctctaatgtgtccccagaaatggatacaagcttcaaagatctctattctgccaagctgtcttaccctcattttatagtttactctgcaagatgagaataaaacctgccttccagggattgtaaagattaagtgaaagaataaatgtaaagttattaacacatagtaatttgtcagtaaatgctgctggttattacttctgtatagtatggttgatttttgccattttgaaagtaggatttatttttaactttattagaattcatcatgttgattcaattgagatcacattgaatcttctttcttttatttgtgatattggctacttttcccagctttgtatgagctgtatattttcctattgagaaaggttacattaataagattcctttatttgtgtgactcaaaatcattgataaaaatatagactagctaggctgggcgcggtggctcacgcctgtaatcctagcattttgggaggctgaggtgggcagatcgcctgaggttgggagtttgagaccagtctggccaacatggtgaaatcctgtctctattaaaaatataaaaattagctgggcgtggtggtgggcgcctgtagtcccagctgcttgggaggctgaggcaggagaatcgcttgaactcaggaggcggaggttgaagtgagctgagatcacgccattgcacttcagcctgggcgacagagagagacgccgtctcaaaacaacaacaacaacaacaaaaaaccaaaaaattaggtaggcatggtggtgcatgcctgtaatcccagctacttgggaggctgcggcaggggaattgtttgaaccagggaggtagaggttgcagtagccaagatcacgccactgccctccagcctgggcgacagagtgagactgagacagacagagagcgagacagagacagacactagctacaggctagagatagtagaacctcctggcaggctggcagagaggcctggatgtaggattcatagagaaactaactattaatgttagtttgcccagctcacatttcaccgtcttatcaaccacatatgtgagaatatttttcaagattttaaaaaatgtatctagttggttcttccctcttaattttcttacagttctctcaatttaattacaaatgtgaggcctccatcctctgtccttagacttcttgcaacattctctttaaattagtcatatcctttagcagtggtactcaatttttgttttatggcccatcaatcactttgcttagagtcactgggttctaacaccctctacaaccaaaataaacttcctcttttgtcaacaagacatttagatgtaatagtgtatagcaatctgtaaagatctgcctacagtagatttacatacaatgatattgatcagatgagcagggtagatcacttaacaggttcagcaaacattgtgacataaagattaagcctgggccaccagaaaactgtggatcaaagaaacaggtgactgaagaataggtgagaggcagaagagtggtatagatggatgttctggtgggtggtgggaacaagcatttgagagagagattggatattggtagttactgacagtatgcctgacagatattgatgggatgtaaggatatagagaacttgacttcttaatagttgttatgaaaatcttgtactcagtctgtttttctaaaccactcactaggtatacttaaacatccttaaaaataagttgcggccgggtgtggtggctcacgcctataatcccagcactttgggaggccgaggcgggcagatcatgaggtcaggagatcgagaccatcctggctaacacggcgaaaccccgtctctactaaaaatacaaaaaattagccggacgtggtggcaggcacctgtagtcccagctactcgggaggctgaggcaggagaatggcatgaacccgggaggtggagcttgcagtgagccgagatcaagccactgcactccagcctgggcgacagagcgagacgccgtcacaaaaaaaaaaaaaaaaattaaaaaaataggttgcatctagggccaaaataaaaacacatggtactgaatgaaaaccatctgtaggcataatttagtattctgtctttatttaattaggggggtgtgtgtgtgtgtgtgtgtatacatatatagcatgccggtgttattttgacatctcatgcaaatggcaagttgtcaaacttcaatttttttttttttgactagccacaggggctcacacctgtagtctcagtgctttgggaggctgaggcaggaggattgcgtgaggccaggagtttgagaccaccctgggcaacatagcgagacctcatctgtacaaaacattttaaaaaattagctgggtgtgatggtgcacacctgtagagctgttcaggaggctgaggcaggaggattactcccactcaggagtttgaggttgtagtgagctatgatccaagccactgcgccctagcctaagtgacagaatgagaccttgtgtctaaaatatatgtatatatatttttacaagctagcagtacttctatcaatctttagcaatggatggtaaaacccaccttctgttttaaaattgtattaaagatgtttatgttactcttctttatctgtctaatctatcatctctgttctctcaaggtaaatcattaattgatttattcagtagatatttgagtgcctgtgtttggcactaggagtacaagaataaataagagctggttcatcctctgttggagtctacagtctggttggggaaacccagaaaaaaaaatgagtgtgtttaggtgtggcaatatataaataattaagtaacttttctaagaatgatgtgaaaaaacaaataacattaaactaattcaaagtgataaaagtagaatgaggttaatgttagatgaaacagactcatcattattttctaagactggatcttgtccttacattaaccacactctcccgcagtggtatggatgcaaagattaaacacttcagctcttaaaacaagactagataaaattatttgtaaaatggagatagtcatttctctgaatacctcatggagttgttgcagaattgaaatgagataattatttgtaaatgctgtgaactagagttctatacaaatagaacttgtactctgatgaaagttgtgacttgaatctttgtccatcatgccacaaaaaaacttttcagaagtgtttggttatctgcctacaaagggagttacgctattattgaaaaaaaaaaccagccgggcatggtggttcgtgcctgtaattccagcactttgggaggccaaggcaggcagatcacttgagtccagaagtccgaggccagctgggcaacatagtaagtaagaccctgtctctataaaaaatttaaaaattagctagtctactcaggaggctgaggcaggagcccaggaggctgaggctgcattgagccatgatcacgccactgcactccagcaacagagcaagaccgtgtctcaggaaaacaaaaatagaaaaagaaaaaaatcagctcctttttattgcagttactgaattcttaagagcctgatttacatgttttctggccagtcttagcaacttactgctttatagctgtactacaaaaatggtgccactcagtcacctaccgaagtgaatgaaaacctctagtctgaatgtgtcacttctttgtttaaacctcttcagtggctccctgttacccactaaaacccaagttcatcattggggcttactaagcttttgggaaggggccagagctatgtccagccttacctgtcacattccttgactcacacgtcaggttcacccttgtttgcagtttacacagcatgtgtctacacacacaccatgaccttttctcttcctggaatatgccccctctccttccttacctggctaattcatactctttcaaaactcatttttcagatagtccttcctgatcccaaccttctccccagtgaagtagtcagcgcatggactggtcattttaattgtcatctgtgttggaatgatcagttttcctctctgttctactcacacttcctagcactatgccttacacataccctaactgaacatgttcaaaactgaactcctgatctctcccattgtccagactcaggctgcaccatatgctgtcttcatctgtttatggtaattacattttccctattgcttaaaccaaaaccttagagtcatcttcttttatatctcataccagtctttctggacatcttgctttattctgcctttaagatagtatgagtatcccagcacttcttaccacctccattgctaccactgtggtccaagtgatcgttgtaccacacctgatttatgcggtagccttctaactactcttctgccttccactcttgccagccttcagtctattttgcacatcaggacttggcagactttttatgtcaagggccagatggtaaaaaatttaggttttgtggcctgcacggtctctgtcatagctgctagaccggagttggggcacaaaagcagccatagagaatatgtaattgaatgaatgtggttgcattccaatacagctttacttataaaaacaggcagtgggctgtggtctgccagcccctgctctacatggcaaccagactacccagtgccttccggtgacttaatctttatagtgttctctaaaaccctccatgatgtgcgtccccaaccccttacctgtctgacttcatcttacgctgttgtctgctttcctccctcctctccagtcacactgaccctctttttcctcagatatgccaggcccattgccacctgattctttgcaccatttattccttctgcctggaacattcatttcttcttaaatgtcaacttctcagtcaggcctacctgaccaaccaccctataaataattacattctagcattatattccctattgcgtgtttttttttttcttcgtaatgcttgtcttctgccatttcttatattatgctatatattgacttaattttttctctttcttttcctgctagaataaatgttccctgaaggcagtaactttgtatcttttctattaagtagtgtatccccaagatctagaacagtgcctgacgtatagtaggtgctcagaaaatatttgttgaatgaacacatagtgtatatttttagggtttaattttttttaaatgagttctttctctctcgccagcaccatatcctttctgtttcacactcttactgttgctctaagctgccctgtcctttccattctcactcccctttattctgactctcatctattagcagtgtgtccataaccttttatttcgtggcatctgggccatcctctacaagtagattgagtgatgtttgtaaaatggaaaaatgattttattattcaaaactctttatttttgattttttgccaattacaatgaagtgcttgtttaaagtacaggatctcttatgaaggaataattgtcaagaaaaaaaagtacgggatctcaggcctcatgccatacctgataagtcataatttcaagcagagggcataagaatcatcataatttaggaagtaacccaagcgattcttactgaacacagttggccaacactggcctgtaaggtaaagttccccagtgagtcagtgagagcctttttgagctgcccctgcctgtctgtcctgccccatccctattgctccacactgcacttcatcttccaacagtttttctatttgcatttctctcaaggcaccatattgattctgtttttgcaaatattcttttccctgtacagaacagaatcttctactctggaaaacttctatttttgtctttcaaaattctgcacgtttgtcactttctctataaagtcttttctgatccccattcccgtgacaaagttaattatgtctttgctgtctgggtactttgtgtaagtaagactctgttctggtgtttattacactgtactgtgtgcctttgcataactgtttgcctgttgtgacctgacctgagccagtagttgtttacgggtattaggtttttattgagaggtactgctgttctttggaggctacagttaaatgagtgttacaaatctcttcccccagaaccgagcttctaaatggcatgttactgtgaaagcaaaactcacactgagttctgccacacacaaaaaaaatttattaggaagcaagcacaaaaatactgttttattaggtggataaaattcctactctctatgcttttagaacatctgacaagcacctttttttttttttttttttttttttttttgagacagagtttcgctctgttgcccaggctggaatgcagtggtgcgatgtcggctcactgcaccctccacctcccaggttcaagcgattctcctgcctcagcctcccgagtagctgggattacaggcgtgtgccaccccacctgggtgatttttgtatttttagtaaagatggggtttcaccatgttggccaggctggtctcaaacttctgacctcagatgatccacctgcctcggcctcccaaggtgctgggattaccggcttgagccaccatgcccggcctgccaagcaccttttatggaaggtttatttaaggcaaaaatgctagtgtgcttttaggattcagctgaacctaattggaatcaaataacagaattcctttatggggaactaacagaaccagcaggagtcataaggctcagggtacagtccctaatagtaggccattagattaactagattcatgtatatgttcatgtaagagcagtggtccctatacagtgtgtagccataacacctttcttgagtaccattcttctctaatactgtcataatttctaatatccactatgttaattactaaattctctggctttgagatgagataaggcttcttgagttgtctcactggagtagggtttttgattacaagctttcctcatttactgatgattatttatatccagtcttgggcttgcatgttaactaagtgctccaggatgaatgtcaggaacctctcactcatgtcctctagtccattaaaacaaataataattacactgtttgtgccaaaataacttaaggaatttaaatcgtaactcttctagaccctggaattgaaacagatgttttacttttaatctctgtatcctcatgcctagtgcagtacctgctcagtgagcctcaagaagtgccagaatgtatgtttgtaatgtcaagcagctaagtgttttgttctgtttgtatttttgtttttaatgccgaattgcagactcttccaacgaattatattaataatatagcaagtttgccatagctgtcagaatatctgtcttaacagtgatacttccttgcatgggctagaatgaggttgtataattccctgggtggggatcaagctgagacctgctcaggatccccagtctccttgtggagagaggttgctctgtcttcctcatgaagtttgcagtgggagtggtgtgtgtgatataaatacagagccctgcttgggaatctaagaaagagttgtgcagtgctggtaagattatagctgaggttaacaaattgtagatctctgttctgacagcagagctagacagctcaaaatataatgtgtttcaccagatgaatttcttatttgtaaagcataactttatcaattcttcactaaaagggaaatgaaagctcagagagtactaaggcatcatgacatatctctagattatactgtcgggagcatcatacttaagttgatttttaagtgtatatttaagtttttttaatcatgggctagaattagagcctaataaggaaagtagtttggtgttagattattaaacaattcataattcttgggccacttggagagtgatttggatcaatgctatttcttcttcaataatctttcattgtttttctgtatttttcatatttctatgaacatgggaagaatcttggatttttaaaaactttacattgataattaatataattatattctgccttcctgtaccgataataaaaactttgtattaacatactcttccacacaagcagagtaaaaaggttgaaattgttgttgtgtcatatgacagcggttaacaaccaaagagctcttaaaaatcagtagggggccaggtgtggtggctcacacctgtaatcccagtactttgtgaggccagagtgggaggatcacttgagaccagaagttcaagaccagcctgaacaacgtagtgagagcccatctctagaaaacattaaaaaattagccaggtgtggtagcgtgtacctgtactcccagctacttgggaggattgcttgatcccagatgttcaaagttgcagtgaaccatgatcacgccactgcactccagcctgggtgacagagtgagaccctgtctctaaaataataataataactcagtagggaaaagattaacccagtagaaaagtggataaaggatatgagcaagcagttgaagaattaaatggccaataaaatatgaaaaatgctgacttaaaaatataagatgtaattaaaacattagtaagataaatgttacctatcaaattgagctgttttcaaagattaaaacttactatgctgggttggcaaatggttaaaaagatgtgtgcactcatacaaagccagtaggaatataagctcatgcaataattctggagaacatttcagcaatcagaaagctttaagacctaataatttcacttatagtaatttaattttaggaaaatatcaaggatttacaaagattaagctccaaaactattgttgatcacaatattattataatagcatttttctaatttttaaggaaactatatgcccttatatgtctttttaaaatatatatatacctatcatttacacttagaaatgaattagtcaaaaaattagtcagaaatcatttataataagtcagcttttgaccactgagttgtttactgtgatcaagaaagcagcaaggcttaaggagttcttattcttttttttttttttttttttgagacggagtctcgctctgtcgcccaggcttgagtgcagtggcgcgatctccgctcactgcaagctccgcctcccgggttcacgccattcaaggagttcttattctaaatgactttatttcatgacaatctgttctctgttctcttctctctgtactcccttggcaatctgtggcaggcacacggcttcagctatcccatgcgaagatggctcctaaatttacatttccagtcatgacttttttttggagttccacacaagtttccaactgccctttgaacatccccacctggatggccttccagcatgacctgttttcttccgtatttgaactagatttttgtagacccccaaggtagtgatagtgatgtgtatgtgtgctttggaagtgggcagggaagagacttaaaaagatttaactgtagaactgaaaaataccatgtgcagtacagcaggttcttgaataacattattctgttcagtgtcgttttgttataatgttgatgagggataaagaatcaattcctggccgaggccaatgtctgtgtggagcatgcaagttctccccatgtctgcgaagttttcttcaggtgctccagtttcctcccacatcccaatgtgtgcatctttgggatgtggactgacgtatctgttatcttagtgtgagtgaatatgggtgtgtgtgagtgcaccttgcagtagaatggcgtcctgcccaaggctggctcccatctcgtgctttgagctcccaggataggccccagccacctgcaaccctaaaactggactaatggcataaataattaccttgtttttattaatctttcttaaatgtgtatatagctcacatttatttcaaggtttaccattagaagtgttttggtctttatttagaagtttggcaatgttttatgaccacaaatatgctgtagaaacttaagttggtttcattatacattgtttcacataaagtttccaagaacctatcgaggctattagtgaggacttactgtacatcttgacatgggagaattgggcattaggcatgagcatgtgccactgcagcaggtggtgggccgcttacgagtctggattaccaatttcatctgaactcttgggtggactatatacatgccttactggagcaaggaattgaagaagaatacagaaggaagttgtttttctctgcctcagttcatatcctgcctctgccatttagagtctctgaccttcggcaatttttttcttttcactccagtttagttttctggtctctaaaatggggggagaaattgtgcctacctaaggtttgctgtaaagaatgaccgaggtaatccatgcctggcctataagtgattagtaaatgttagctgtcagcctctacaaaaggcatagtgctatgtcaaagcatagtgctttgataatatagtttaataggataaattttcagatagtaaaccttttcccttcattcagggtaaaaataatagttctgtaacccatcaaagtttagttctctaagctttgtatccctgttttaaaataattcagctcaaaaaagaaaaataagtttcctggttcagcttcatattgaagccttctaatgctagaaataaatgtctctagattcctcagaggcattgcggacctcttccttccttttattctcagagtgaaaaacaaatttatgctgtttcctatcttaagaacattctcaatcagccaggcacggtgtctcacgcctgtagtcctagcactttgggaggccgaggcaggcagattgcttgagcccaggaggggaagaccagcgtgggcaacgtcgtgagaccttgtctctgaaaacgtaaaaaagaacatccttaatcatatatattttcatatcagaaaagaaaaaaatagtattgttttgttttgtttatgtataaataggtttttctcgatgggaaattgaaacatttaaagttggtgtctctataaggtggcaaattaggaatttacctcagaattatatagtggtggattgcattgtttctttttcaggctttctggtttatagggttatgttggtatttttcgtgttattctttttacaattataatcatgaactgctgcctttcctggggctggtattggcaagttaattgggttggcagatccatgcaggccctgtggagcactcatcccctctcccttcttcctttctcctcatttttcagtattcctgtcaccagagcagagcacaagggacctagggaatgccagataagactaaagtggtaatggccacttttaaataatacatttagatggtgataattgagctatactgggaattatagaacttaacacaattacattaaatttattaaaacttttcttcaaaacgtgagatttaaaacttttctttactctgccttttattttttcaaagaatcctcacttggaattcaaatactgtataggaaacagctaagcactgcctctagtttaaggttggggttaaaacctgcttgtttggcctcttctcatatcacttcattcccaattagtcccctacccctagatacctccctagggctccagggctctaaggaaagagtttagaagtgaataatacaaacagatccccggttgggggataatcctggtgccctcagttttgttctattctgggatgtctggctcattttgacagttatcgataaactcctctcctacccgatgcttgtaattaaaactgctctttcacctagtgtttccattttcatgtacagtgactccattcatttacttacctaggctgaaaaccccgtagtcattcttgactcttcttactctccactcattagcaaatcatgttggttttctgccttcagaatacaccccactttgctactctgggctcagcctctttggtttcttgcccggaaactttaatagctaacttagtcttctcttttcactctttgcttcctgcagtctagtacagtggttaattccatgggttctggaaccagattccctgtcatgtgactttgcgaatactaattagcctttctaaacctcagtttagaggaatgaggatgagaacagtgatactgtttacctcacatggttgtgtcagacaacttgttatgcacaaattacttagataggacatggcaaacagtaaatgtcccataaatgttaggtggtaagagatattgaggttgttgtggttgtttttattcatacagacttgaaactgatattctcaaaacattagtcagatacattctctgttggcttcctggcccttcttagcacaatatccaaaggccttcctgtggcttaccaagccctgcagctctaggttacctggttcctctctgatcacattggcccgtgctcgctgtgttccagccacactggcctgctgctctttcctgccttgttcagcctttgagcactcattttccctctgccacattgctctctcttcagagatttgcccaacttgccgctcccttcatttaagtctaaacccaaatgtcaaccactgttcaagaatatcatgtcatctttctctatatacctaatttttttcatatcttaagaaaatacaacttttcactacctaacattacattatatatctgtttattggctaattatgctgttagaccagatttcatagtacaatagtcccctcttatctgagggcaataccttccgagaccaagtggatgcctgaaactgtggatagtaccaaatcctaatatactatattttttcctgtacatacatacctataataaagcttaatttataaagtaagagattaacaacaacagtaaaataggacaattataacagtatgccagcatcgctactcttgcactttggagctgttattaaataaaataaggtttccttgaacacaagtaccacgacgattgctctgatgacctagaaggctactaaatgactaatgggtggatagcatctacagtgtggatatgctggacaaagggatgattcatcccaggcaaaacggggcaggactgcaaggtatttcagtgcactactcagaatggtgtgcaatttataaactgtttatttctggaattttctattaaattttttggactaagttgaccaaaggtaactgaaatcacagaaagcaaaacttcttataaggagggactatgtaaatgagtgcaagggaccttttctctttggttcatcgttttagccccagtgcctttcatatacatagtcgatgttcaagaggtatttgttaaatggatatatgggatgtgatggggtgagtgactgacaaatattttccccttccttctttacacaagagatgctgaagttaccagatagttggaaaggcccaaattaacttttttgagatgtagagttcaggtttcccccttctttcccatgaataacaatatattgtgtaattcatcataattacttcagttaaccacaaatggagtaattgcattgttaaattagtaccctcttacagttactattcaaggtaaacttctttcctgggtagctagtgacaagaaaatcatttgggctcatcatttattgagcacttaaacccactaagcccatgccacactcctggttgttaccaacctccagtgctgaaagaaggaacttgttaagtctgtctggaatcaggaaaaacagagacatatataatgttctccaaaaattctgctgcttataaagagcagtgaattcagagtgtctagggaaacaggatttttaaataaggatttaggtttaagatgcctcttagtttcttagggatgggaagtgagttttaaaaattagcatttttcttttaatatgatagtagaacaattcggttactgtttgataactttatactaattcattgactttattatatgaagaaataaaggacttcaagaatagctcataacaaaccgggtggcgtggtggctcaagcctgtaattccagcactttgggaggctgaggcaggaggatcacttgaggtcaggagtttaagaccagcttggccaacatggtgaaaccctgtatctactaaaaatacaaaaattagccgggcctggcagcatgcacctgtaatcccagctactcgggaggccgaggcaggagaatcgcttgaacctggaaggtggaggcagtgagctgagatcgtgccactgcactctagcctggtcaacagagcaagactctgtaaaaaaacaaacaaaaacaagaatagctcataaccttgaacgtctttgtttgttttcttcataattcctgagaattttttaaaaaataccattaccaatttcagttaattatcatgtacacctagaatatggaagttattttgtgctttttattttgggcctcttttctacctttaagcttaacatccaacagtcttctgaaccatatcttgttataatctgagcaaataattttctttctgattgaaagagggtaaacataagctaatttgtttagtcctttttttaaaaaaaaatcactgacactaaatgagttaatgtttggagtttagttgacctcctaaattatccctattacaacatagtaagacaccatatctacaaaaaatacaaaaattaaccagcctggtgacacgtgcttatagtcctagctacttaggaggctgaggtgggagaatcacctgagcccaggaggttgaggccgcagtgagccatgattgcatcactgcactcgaacctgagcaacagagccagaccctgtctcaaaaaaaaaaaaaattggtaccattcagagacagtgtcagatggggtgttgactgggttggttcacctatcagatggtaaagtaggtgttctgaggtgagctcaaggaagattgaaatctcccatggagcaggacaaaaacgtacttgatcttgattatctgtatttataaagattgtcaaagtaggaccaagaaatttttctgatctttggagttatcactgtgaagcagaattcaccagtccttgttcatcaacctatcttgtgttccctataaatgttaatgtagaatagccttatcttatctacaaaatattatttttattagaagaatctaagtgtaaatcagtagccaaaaatcagagatctgatttattagctgttctctctttttatttatacatggactttaataatcattattatcattattacaggccatggttgcttgttatccgggcaatggaacgggttatgtacgtcatgttgataatccaaatggagatggaagatgtgtgacatgtatatattatcttaataaagactgggatgccaaggtatgcaacttaattgagcatttatttttttcttacaggtgtctttttctcaaaagcattaagtttcatacttctgataagactgtcacagacacagttaaaaattttcctcttaaatttgtttcagtctcaggtattaggagtggatttttgtaaaatgaaacaaatactactctatgttatacaacatgatacctgtagttaacaacgtagtgttgtgcacttaaaaatttaagagggtagactccatgttcagtgttctaaacacacacacatacacacacacacacacacacacacacgcacacacgaggttaggggaagggaaacggaactttgagaggtgatggatatgtttattaccttggttgtggtgtgtcatgagggtgtgcgtatatatccaaactcatcaaattgtaaatgttaaagatatgcatttttgtatatcagttatacctcaaaaccatataaaaaagtactgatatatcttaaaaagtggattcatttattttcagatgttagagcacttatctaaaatctaacttttttagaaaggtgacctttattaaaatattttccttttaatagtttttagaaaaacatttctgagaacagttgttttataatggcttttgggggagattatctatggataattgttaaggattatttgctatgttattcttggcatttttgtaaaaatattatatggcattgagttgtttaattgaatattggaggcaggattcagtctttccctgattattaaaaaactggaagtttatcagtactgacaagccctgtaaaaccaattagaatgtacaatatatttaatctctcttgttttaaatatatatttccttaatattagcctgagtctcattaaatttaaatgatttttaaaaaatatgtcatatattactacactagagactgtacagactaattttttggttgattttttaaaatcttaagtataacattcaaatagaaaagtggcttgtatagttcagtggattttcacaaagtgaacatacctgtgtagccagggtgcctttttttgttgtttttaagtcaaataacctttaaaaaacctctttctctgcatcccccaaaacacacaaatggaaactgcctgagtcttaaatgtgcaaaaacctaatcctgccctaaaaagtgttttaagtttagaatatgctcacagtgcttcactaatctttctaaaacacactgatttaaagagttttctctgccctagtccaggttcaaaatggagctgacctttctgctgagtatatattgaggcatgtcaacaagcatggtttttctgttacagctttcaaagtttgaagtagagaaataaattttgtaattgaatttgagcccaaggcacaaaacagatgggtgtaactttagttaaaatttaaaaattgactttttttcagattttgtgaatagctagaaagctagaactgtgtttcatcagcttctaacttctagattttgttaggctttttctaggctgatcttataatttctataatacttagtcagggtcattaatgtgtaggttttaaattaggacataggcagagaaacgtccctagtgtttttgtgtgtagaatagaaattttccatgctagattgcactgaatatgtagtgtgtcagttgttctggatgctagggatgtagcagaaacggaattagccctggcagagcttaggatctattggaggatacagatcagaaagattgacagttacagatagttatgcaaagtgtcaagacagattgctatggagcacacaggagggccacctaattcagaggaggaagagtggaagtgtcaagtagccatttcacttaaaacattttcagcaggtcacctgtggtactcccaatgacttgagtcaaagggaagggagcaggaaaaaaggaaagaagacatgttctcagtttggaggttctttagatgtttgcatagtagcctggggaatcactctgaacaacactggaacctgaggaaggttggcaagggtatcaaagtagctagaatttaacttacctgacagtgagcctgataaaccttttctttaactatagattctaggtttaggctcaaacgccatgttgtcctgaccaggtgttagagtttctttaaattttaagagtctacctgcttaggagtgtagttattcaagagtaaggagctacttggttggttgggttttgcctatccccagatcgtaaaccccgcaaggacaaagtctgtctgcattattccctactctgcacccagagcccaccacagttcccagtgcgatttgatgcctagttggtgtttaggtaaataataatcctttatgggtagaatcaagtttcacaagcaggtagtcatctgtgcatcaggcccagtctggaaagggagagccacaggttctaatgaactatatgctgatggtgatggtgacgacgacaataatgatggtcataataaatgatgacactttctactgatatactgaattatttaagtaagaggtatttgtgactatcctattgtttattgaattttaaagtatggtaaactatttgacataatttatttctaataataattttgtcaaaatttcttgaaatctatctatttgaagggtgggttaagcaaatcattaacatacaaaaataaacgtttagtagttttaaaagctttcaagcatcattttaagacttttaaattcagataacattcttgtgtttcatcagatatttataaaaatccctaaaatggctggggacagtggctcacacctgtaataccagcactttgggaggccgaggtgggcagatcacctgaggtcaggagttcgagtccagcctggccaacatggtgaaaacccatctctactaaaaatgcaaaaattagctggacatggtggcgcatgcctgtaatcccagctactcgcgatgctgagacaggagaattgcttgaacctaggaggcggaggttgcagtgagctgagattgtgccactgcactccagcctgggtgacagcgagactccatctcaataaataaataaatatccctaaaataagaactaaatttgtccttgcatcagtgcatatacttttaaaattgcagctcatcttcatactttattgagacgtatttgtgaataatccaattaagacattgaaattgtctctttttttccccctaaatttaatcttgtagcatttttggttactcctgcttacatatttggctcttttcctaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtagtattccttttcagaaaaaattggtttagagtatggtaggacaggagggaatctgtagagtaaacgtgaaagctttctaatgagtattttcctgccaggtacttttcacagtcattttaatttgaataattgtataagatttatgttgcacagtcatctgaattcaaataattatataagactcattaacagttagtactaaatgtgtctttctttgcacagccactctgaagaaagggaagcacaggccttcccatctttctagcactctctccgtgctttgtgcatctcttaactactatccatgctttgatttttgtaagagtattttacttgggagagagaaagatcaagaaggaaaagggttttttaaaaggtggtgagggacaacataggaaaatggatacagagtagaaaaatcagaggtaaccagagagtagaagtgaagagaaaaacagaagaaagaaaagtagagaacaggttaccatgtgtgggagttaatgttagaaaaatgatcctattagctttacaaataatgagcatctgtttcattatactttttctacaaggtatttgcaacctattatatttagtgctttatttcaaatgcttttttaaaaaccatttatcctgactcaattaaaatgctctggctgtgaaaacaagatattgtagacattatcatgaaagtaaatatttgtagaaaaatagcacattaaaaaaaaatacttattttttattatggaaaggtcttggaacattctgatagtgagcttccggcattcatttgctgtatctggcttaggagatgctagggtggcaagaagaggcacaggcttagatgcgctgggtggagagttggctttagtaatgatggttgactctaacgacttgattatcagctgtgccttttttcttcctgccttctgaggtgtgttgcctgcatcctaattcacgtactgagtagcaagctaagcaggttgtagctggagattgtaagaaatcctgaatggaaaccaaagaaagactgtcacatcacatgatgtgcccttttcaatcccatgtctcttcccagtggcatcccagtgctgtctctgccccctgctgcttctgtaaagattttctgacacagtaactgcctcatagaccttcctttttatgaaatcctgagtttggtttggttacgtcctttttagatgaataaataacagatacttgggagtttatagtaaataaatgccagatggcatggaggctaagtgctacaggagttgaggaacgaaggtggtgctacattggagagacgggcaagtgcgctttgaagggagaggctcagctggcctaggtgaggagaggcaaggggtgcagtcgtgttagtaaagttctgggggaaaaggcgtagttgttcaagttaaggcatggaaaatcatgcgacgaaaaggattcttgaagtagaatcctattctgatcttatctagaatgggtgataaggctggaaagttagaatgacataaggtaagttgttgatccagatattagaattctgattgctaagtgactaaaagtttagggcatgggcaaaagatacataaaattatgtatctgagccctttcctatttccaaggccacccaaaagtagaagaagccacatggtaagaaaggtagtggaactctggaaagagcagagtctggtctggaagtcaggagacctccttagacctcagctctgtgattcaccagtggtggggtctgtaaacgtcaggctcccagttgtccaaactcccagactctttacttcaaaatacattatgtgatttttcattctgtcatattactggctgtatgtctgataaatgttgccttttcccctgtgtccactggccacaatccacaatatatttgaactaattgctatattctgcccaggaactggtgatttgtagcgtactttcacttcctatagcgtttatacattttccccattatttgtatcagaaagtatgtcttttgtagtatttaataaactagagatgcctcacttattggtggaatgaaatattctaagtcagattttcagaaaaatgaagtttagacaaagtttaaacacaaaacacagtataattgctttgattaaaatccttaaaaattcttagcataatttaactgtcaaggttataattgtaaacatccatcattactctttgctataatgtagtgatgtccccagagactgttgaaactgttagcctgcaatgccctgagtccttttatctgtttcttttctgttcttttagtacttgtgctattgataatgtgctttttctgtaacagccattcttttacccttttattgtctctctttttttttagagggaggctcactctgtcacctaggctggagtgcagtggcatgatctcggctcactgcaacctccgcctccccgggttcaagcgattctcctgcctctcagcctcctgagtagctagggctacaggcatgtgccaccatgcacggctaattttttttttcttttttttagtagagatggggtttcaccctattggccaggttggtctcgaagtcctgacttcatgatccacccacttcggcctcccgaagtgctgggattacaggcgtgagccactgtgcccggcctattgtctctttctgatctgcagttcccttgcaaaaaataagtagttgaaataagtattaagaaagtcacaaaaactcatcaacttcagacatcaattttagtctcccctggttactgtataaataagctgttaaatttatcctttgatatcattccagtttaggcataattttggcattacaagttttaatataccattgcagcaaaataccactttttccccgcagtgtgatcattcttatcctattctaaattttcttttaggtacgcaataactgtttggtattttgatgcagatgagagagcacgagctaaagtaaaatatctaacaggtaaacgtcatttggggccaggatatattggtacagaaataccctgcaatcaggtgatgctttcaggaaactcaagcatagtctttgttaacaccatgaatacttactttttgttttttatcagatttcttatttgcctcattttttaagaagacataagtcatcttcactgttatctttaaccaaaaaaattgtcaaaggatgtggaaaatttgaggcaaagaagtctgagtaaattattcacatacaaactgagttttctgtgattatccttttcagtcaaaggccacttaactctaggtaacggccatatggtttcctctcattcactccttaaattaataccctttccttttcaaatggatgtgctctaaacagtactctaggtcttccatgttaaatgtagacatgaagaaaattaatacaaagaattatgaattcaaatgccaaaatcagtaaatgacacagacatgtagattccatatctgctaatggtgtacataggtcagcactcttgtactgaacctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcattatctctgtgtagaggatggttttatccttgaaggtttactatttgaaacctcatcacaatagaatgctgagggaagtttttggaagtacaagcgtgatagttctcagatgatgtttgcaaagttgaaatattgtccatactcttaggaattcagtggaatgcagtagcagaagctctctggtgcttagtgaatgaatgaaaattttttttttttttaccttgcaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacatta

SEQ ID NO: 149 - DNA, 9299 bp, Homo sapiens
acgtgcccaccgggcgaggcggggcggggcgtcgcgcgcggtgggggcggggtatggcgcgctgtgcggcgcagggcggctggcacaaacggcggcgccggggccggaggaaaaagctcggtgaggaggtcgcggggcgagaagggagcgggaggagactaagccggagccggggcgccggcgcgaaccgggcggggtgtgggggcgcgcgccggggcctgccggggcgaccccgggaagggggatgtgggtgcggcgcgggggaggggacgcgcgccggttacgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcggtcagtctcgggacctcccttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaaccccctcctttcccactcctccacaccacccttttctactccagccctccttcttctgtctttggttaccgcgtcccacaacctgcaccacagtcctctgtcttagggtcatctacccagcccctggcctccagcctctccctatcactgcctcttatctgtcagcggactcccgcacctccagattctcagggtcctctccccgacttggcctcaggttttggggggcctctatagtcaagtctgtcctggtcgtcttccccactcctgcccataccatcccggctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctgggctgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggctcagggaccagggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccactttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctga

SEQ ID NO: 150 - DNA, 26869 bp, Homo sapiens
tcccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggtaggacgcgctcggcgccctgccgcagctgctcccgcggggacgggaggcactcggagtccgttgtatgtcgacttcccagggccgtaagcgaactttgttttttaaccaagaagtcagcctggtttgtctctactcgctgcttccccccacccctcgccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagaaaaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacgttcagaactacggaaaacttttactgaaacagcgaagcagagtataccggcatgagagggaagatgaacactcacctatgtaccactctttgacaataaatatagtatttctcaaatcagtctcaagactgatcctgtctcagaacagaccattgttctctcatttctctaatacgctgagaggaacactctgaataaaggctaagtggtgaggattggaaacgtgtgggagtgaaggggtggaggtggatgagtgcagtggggagtcacagtttgccgtacaacttccaagccaagaggccatgaatagaatatctgaaagcatcgttattaatgcacccaagtaaagtaaatcttagaagatactgctttctaaattttactttggggaaaaaaattccgcgtgagctgaactctgtaggagattgatgctaaagtgtttctttattcttcttccatcatgttggtggtggattagtcactcgtctttgactagtttgatttttgcattaaatgaccttgctgtcttctgtggtggaggtgtgtcggggaggggaagggtcagcctcagtgttgctgagatgctggtagtttctacctggaagagcagacggcttcttattgggtttttaaatgtttcttgtaaatttaggtgttaggagtttttcttcatcattctaggagcagaatttgctctgagggaggtcaggattaattggtatggaaagaggccactaacattgaaagttaaatatttttatttagctttgacttaatggatagggatagggtttcagactagaatttaactcaaatggaaggaaaaacactgtgtaagttagggtaagggaaagaaagatcctgtagatatgattcatcaattttaggttatcttttgggtggaatgaaaaactttccaggtgaccctgtcagaaggtgatcgtgaattgaaaataaaatttatcctgtcccacccccagatttccaggtttactttggctggtttgtcacaaagctccctgccctttagataaatcacctttcgattggaatattccctggccaattagaaccaaatgcaaaccaggcttgagcaaacaactagtgtagttaaattttttttaagtgtgctttgcttgtatacagaagtctccttagtgatgtcttgtggtcttgggtttcttgtttgaagttcattattaaagtcatggtagaaacactttccatttctacatgatttttattggtttcacattaatttatccttctttttcttcactcactttttatccctcagctgagctcctcattttgtgctgctttccagagcagtgatagagacccagtttaccggttcatccttcacccgtgttttcaagaaaaactaaagttttaaatttatttattattattatttttttgagatggagtcttgctctgtcgccaggctgtagcggctcactgcaatctctgcctcctgggttcaagtgattctcctgcctcagcctgctgcatagctgggaccacaggcacgccaccctgcccagctaatttttgtatttttagtagagacggggtttcaccatgttggccgggctggtctcgatctcttgacctcatgatccacccgcctcggcctcccaaagttctgggattacaggcttgagccactgtgcccggcccttaaatttatttttaagttttaattaaggaaattttcaaacatacataaacataagaggctaatataatgagctcccatcacccaatttcaacaattgccaatatgtacatttgttttagaccaattttttttagctactttaaatttcttgaggttatgcttattcatgcacttacccaaatttcatttctttttttgttctttgctagacttggaaagatcattgaataatattgccctttatctcaatgaaacaatagcaaagatattgggagtaaaacagaaagatacactggacctaaaattgaaattgtggaagaatatagaaagaaatattagatggttctgcttcctgccaagaaagttgttaatggtcagaatttgtctacctcatctttgctggagaaaaatccaagggtgttgaagaccccttgggaagtggttcctgtaatgtacagctgtatggccccccctaacttcaagcatgatcattgctttcaggctagcaaaggatttatccgctcgctactcccttttggagattttagaccatatccaagataaatattggtcataatttgctcctttttctttggctgcctagatcttgaaaatggctgttttccagagaatgtataatttttagaaccaaaagtccctctgcttcaaacagctcactgtagactcactagttagtgactctaataagaagaactaccttttattgagcagtttgtattgtctggcactgtgctatgcactttacaaatactatcttgcttaatcttcagaaacacagtcttaaacatattgagtgattaaatactgtgcccaaagtttcaaagtcagtggtaagaaacagtttaaatgggggctgggagctcaggctcagtgttaactaacttcgtggctttaggcaagttgcttggtttacaccaggtgcaaaatgaaaggaaataatgccgtaaagctgttggaggaagaagcattaaataagatgatgtttatgaaatgtttagcagaattccgagccttcatcagtgttttaagtctccagaggggaaatttgggatcctaacctagatttgtgtaactccagagactgtgttatttccttttattctctcctacttccgacctttcatttattcagcaaatgttatggagtgttcagcctgtgtgggatgctgtgcaggggtggtggtgccatgatgaacgaatttatactttcgtatactttgaattgtaggatggtctcattcacacttgactaattcttaggcttaagaaaaccctcaaacattgaagtgggtcagttgagtacatttgaagaaaaaaatagagtactgtgctgatgttttcctactgttttatttatttatttatttattgagacagagttttgctcctgttgcgcaggttggagttcaatggcgcaatcttggcccaccacaacctccgcctcctgggttcaagcgattctcctgcctcagcctcctgagtagctgggattacaggcgtgcgccaccatgcccggctaattttgtatttttagtagagacggggtttctccttgttggtcaggctgatctctaactcccgacctcaggtgattcgcctgccttggtgcctcccaaagtgctgggattacaggtgtgagccaccgcgcccggcttctactgttatttttaggaaaacatttattgatagggtttgttcgtaggattcctgaccagactagctctggaaggtggcattgtgaggactgcattgtgaacagaccaattggtcctcccctggaaacaataaggaggaatgatgaaacagcaaaacatttatgaattaaagaagatgtgttgcaaggtggtgtgtttattccttgctgttgagcaataacagttttggcccacccttctcatgtgaggtcaggaatatacattatttaatggagcttatcatggttgcaaactactttaagggaaaaatgaagcaatgtactatgaagtgatctcgcaggatccaagtgcaagaaatgcagtcagggttctcagaagcttagaggtatgaactaggaagcagaaagtccttaacatccaggacagctggtgtgttcttttctcaggagcctcatgacctccatctttgcttccctgcttttgctcttcatttcttatcctcttttcaatccagcttttgctgccttcccatgcacatggctcaagatggctgccccacaatggccacctcagcctttagttgcagatgagcagagacttcagtaacattcctggatccctgttttcatcgcctgggagaaagtctgattgtctcaccttggctcaagggatctatcagccgtagtctggcacagtgggaggcatgtggaaaccatgcatcacaaatatggttgccagggcccatgagagttatagctcttagagcacagagtttgagagctggataccataaatggtatctctgcaattagaatcttagaaatctacctgtgaataaggtattttggggaggagtgctgctgagtttgaagctctggaacactgtgaataaggtattttggggagaaggagtgctgagtttgaagctctggatcatctttctgtaaggatgtaagggattcctataaaagcttttgtattaaaaataacttagctcctgtaggaaggaaattactccacagtaataatttacagaatacagtcccagtgacagtgaaacaagtctctccaatgggcaagttttcatggggttttttgtctattttgtgaatgacatttggaaacaaaaaaggcaggagggtgtgtgtgtttaatttgtaatttcttttgctcaattttgggccactggccacttcactataaccttatctgcttcagagaagtggataataaagggatatcgatttaattcattcacagatcactcagtgctgcacactgtgggagacctgtccgtggatggggaagggaagtgcccagtgattacaaaaccacctgaagaactaagctgagagttgagtgtagtgtgcagtggttgtcaccaattctttctctttttctggttaaaaagtgcacgtttacgctcattagtcattgtttctctttgggttttctccaatttctctgttaatttaaaatgaagcaaccagaacaagtgatcaaaactatacaggatgttaataatatgggtttttagggctagagagatattagaagtcacatctatccaatgtctcagtcattcagcagttgttttcatatttggagagatgatatcttgagcagatccttgggaagggatggataaaaggtactttaatagagaaagggtggctgggtgcagtggctcacacctgtaatcccagcactttgggaggccgaggcgggcagatcacaaggtcaggagtttgagaccagcctggccaacatggtgaaaccccatctctactaaaaatacaaagtctagccgggcatggtggtttgcgcctgtagtcccaggtactcaggaggctgaggcaggagaattgcttgaacctgggaggtggaggttgcagtgagccgagattgcaccattgcactccagcctgggcaacagaccaagactccatctcaagaaaaataataataataattaaaaagaaaatagagaaggggctacgctggctgggtcagacagactgggaccagggtcagtaggttaattcagtggcatcaccattttatttgggaattttaaatataattctgactgaaaattgataaacacccttaagtggagttatgcaagcctgtctctgcataaggttttggagtatcatgaatgatttccctttctaacctttctgcttcagctcaagcaaaattggtaaaatttttcctgattcctgaatctcctggaaaaacttgtaatttcataagtaacaaacagccctccattttatgaccctatcccaagaacacaccatgtatgaaagatttctctgaggaagcttaaaggtcagggtggcgttctacccaacctctaatgagcagagtttaagcactgccagcatcttgtgtacttccggataaagcttggaaggctgctcacctgtgggccatgtttggtttggcaaggcctctgcttttgacccaactttgcagccctaggtaaattaaattacattttgatctgtgcccactgaagaccaagaagtagcttgcaggttaacattatggagaaggttattaactttttgttaattattacggcaacagactccacaattccttggtagcagcactttgtagttgttaagtgatattgctctaagaaacgggtgtcgcttttctctagtgtttgtcaaatgcacatgttctgacagtaatgatagttcagatctattttgctgggcatctgccaggggtgcccagtgggtagctgaatccagaggcactggaattgtaaatacaacagacaaatcatttgatggtgccagactaaggagttcagctttggcagattgccaggagccgttgattgggctcagattcagtgctatgtgtctgtttgccaagcaagattagttgtcttggttaattatacatagaatttgtaccccctttctctcgattatttccatcttaaaccggtatgacatttactttaattttgcatcttgttttgatattgatttgtgggtgagtttctgtccctgtttttggtgagtctgtagtgactacgttttcctgccccggtcctaacacaatcccagccttacagaccctgggtttgctggtgtataatgcaggctttcacatcttgtattggattcatttggtaccttgttacttagtgttctccgtgttcagtacagtgtcaatacctccttattaaatcaagctaatttttgattctttagaaggtacaatgattctcaagttctggagtacatgtgcctatcttatattaaacattagtttttctttacaaaatgaggccaaaatacttattgttgccatacaaaaataattccagaatacaaagaatcaaataatatgatagtaacctcaattctttgtcagtgggaagaaaacaaaatgaaaaactcaattccaggtgtcaataacatctattttttattctaatgtgagaccctgaagttccatctttttgaagttgtcaggataatttcatttgagcattgcttggaagctgtaaggatatactgtttgggacccttttatttatttttatagagatggggttctgccatgttgcccaggcctcccaaagtactgaaactacaggtgtgagccaccaggccaggccaacaaaaccccttttaaacacaaaatattgaagattcaggcaagaacatgcagtattgctagagaagggcctattgtgctttctttgtttagttttactttttaggttcactatagaacctcaagttgtcttttttttttttttaactaaactttctttcctttcttagtagaaaaatccttgaggggccctttcttagtagaaaaatccttgaggggggaagttttttaaagtaacttactgtaaccataaatcacttgccgttggttcttgttcttcctgtaatccattttatgtacttttgctagagtgtagtagtcccaattccaattctaatcatgtagtctctgtgcttaaaacaaaataatccaaaaatccaaccatgctccttcttcattatctactatacaacactgtaaagactgtaaacttagccagctttgacagccctctacatctgaccacatctgacctttctacacttaatttcccaccactgccttcctttcctcccagtccctgaaatgctagaaactaatttgccaggcataatgagcttccccattgtcttccactcatcaaaaatccatctctaccgccttctagtgcctgttccctgaagtcttcccttctgctccccagaactctgtcgtggctcaatccaggctgcccagtacatggatttattgggctgtttatgctgtccaccgtgtgcttagaaattccttgaatgcagagactgttaagctttgtatatacttttagtgcctagaacagtcccttatacttcataggtgcttgttggcttaatttcatcttcaaaaggaactttgattttgatggatatttgaatgttaaaaaaaaagctagaattttttttgggggggatagaggggaatgacgggggaagatgggtggctgcagcttagtctctaattcgatgcctaagtatttaaatattttattagagtgacatgttatgtgagaccatctcaatggaggaccttagctttgtaagttttttttttttctcagtttcgaaatcctaggtttcaccctagaaatacccgagtcacacctggatcctggcagctcatacctacaggtctggctcagagacgccagggccacgaggcttagggccccaggttctggtcctagctcagcccctggcaagtttcatggtcctccatttccacttctttatggatgagttagatacttgttttcatttttgaacttaaatttggtcagcacctaccacttgacactaggatggacacttcagattttatttcatcttcctatgatcttgggcaagtcagttctctgagcccactttcatcatctataacataggcacaataatactgtatgtctacttctaggattataaggaattaacattgagatgacatttccatttgagaaggaaaatagttgctttcagtgccttttatttgattcctggagagagcagactcgcaccgacattcaaccccagcgctgatatgacagtaatcctcagaggcagagcccagcacaaaacagcaatgctagaaagttacaattggaaagtttcctgccagcttcgggaatgacactgcaaagctgatgccagaaactgccagagtaattctcctcattactgctctacccacccactttcagctccccaaattaactagtgcagttgactaattcctctttacctttatcatttagggtgaggcattgcacaaaaactctcgactttgccatataagggctgtggttctctgtggtccctggataagaggcatcaccattatctggaaacatgcagtaaatgcagattcttcatcttctccccagacctcctgagttagaaattcacaagttctccaggtgatctcatacatgctaaagtttgagaaccattgagtaaagttaatgcattaagaagagattagatagggatggtggcgtatcttcctacagtttccctgttaacaagaaagtcagaggtcagttgatcagacattagattatttattgctaaaactaaaaaaaaaaacaaaaaacgatttttagttcacatttatagcctattatttgtaccagcatatttaattttccagaactagaattgaagcaaattttggaaccagttccctcctgttatggtgaatggaggtgaatgtctggcctttggcaagacaactgcatttgaggcctatgtggaccctgcaggggctacagagattttatggtgggcttgaggttgacctgcactgggaataaccaaagcaaagacaagatgacttggacaagtagggtcaattttcttggcctcttgcctttgttaaaattccccctttggatctttgagtttacagactgaataccaagcacactcttttaaaaaaattcttgcaattgtttgtattttgtgatttttctatcactctggaagggtgataggcaaggatgaggtaggtggagtcaaatatttcaagtagaaccaaagatcttagttccctcaaaaatgaggtgggggtgaatttgctaatgtcagacattagataaactgagttggtaaagcacgtcttaagacctcacactcttcagccagaccaactgggttcaaaaaggcaagttacctaagctctctgtgcctccatttcctcatcggtaaaatggagataatgttcctacttcatgcggttgttagggagtgtgaaggaggtccgatttgtgaagcacacagaacagtgttgggcacatagtaaatgctttacaaatgtttgtttagtaaataaatatagccactgaatttcatgagttctaatctacgctaacttgctgtgtgtcatttctttcattcagcagatctgtttttccaagtgctgaaatgcatatgtaggtttctcctgttttaagattgtttcggccgggcgcggtggctcacgcctgcaatcccagcactttgggcggccgaggcgggtggatcacgaggtcaggagatagagaccatcctggctaacaaagtgaaacccagtctctactaaaaacacaaaaaattagccgggcgtggtggcgggcgcctgtagtcccagctactcgggaggctgaggcaggagaatggcctgaacccgggaggcagagcttgcagtgagccgagatcgcgccagtgcactccagcctgggtgacagagcgagactccgtctcaaaaaagaaaaaaaaaaaaagatgattgtttcaaggcatttttcatgacattttgattggtaacttcgttttttcatatattatccattattaaagtcttgtcttaccaattattttgagttatggattctttaagtactttaggattaagttcagatgaaaatttcaaatattccattctctgatgagcctgcagtcacaagtattccttgtctctgttatgctcaaagcctttagagagccataggtgatgttttattattctgataaggctgttttctcatatcaaaggaagtcgaatattatgtttctctatagaaatacctgtgataacttctaggtccatagggtaacttctagggttaatgacttctaccaaggacttggagcggtgtgactcagggcacacactgctgctcaccttcccagtaaccaggaaattaaacaagatatgtgcaaaatgccaccgggctacatgaattctcaggaaacagcagctgttaatatttggggaaaggcatcagaaaggaaatggttaaatgcgtcttgatgtccttatccctgggctggactgacctttgctgattttataattgtgaggaagcccggttgaaaacatttctctggtgactggggtagagatgggggagggggatggttcccagtgtccgttcccagctcaggctgcctggcggtgtgctcgggtgtgggctggctgccaccctcacgcagcgcacgtagccctgtcactcagccatcaccctgctggcttagagccagtcctccacgggaagggcggcctgcccaaacccaaacaccctgtattaatatggcgatgttgccgggcctgtttactgtgcctaattgcatgggctctggctgaatcccctccaaggagaagaattaaccacaatgcagaaaggaatgacaatagtctcttaaattcctggcctctgagcctttcagtggcttcttgggggagggcgattcactcagaaggtcgtgcatgaaatgcgggatctcctggaatagaatcttgatcccgcacagttcaactttagaggcctttgaaccccctagaatttcgtgcagacttctgtgtgtgcgtgcatatttcttacatccttttaatgtaagaatctcaaagggctattgtgcctggtagaactatcatcactgacccaggagaactagatggatgcttccacgctctgggtagttaatgatcctgaagctaggaccaagttcatctgaggacaggttttaaagtgagaatggtaaattctctgctattcaggcacggtgctctcacctggccaggagggtgtgggcagacccacttcactagagcaaccgagagtcggttattacttcttattttttattttcagaagttctgaagtttctacaatattagaaaattcaggtgtaggtatgtgatgaccgttgttctaccttgggagagaggtcatgtgtagcagtgttctgggtaagtaggttctgcgagaggaattatttttagtgtggatttaggacaaatgaggagggcagaagtagtctgcattgtggaagtagagtagtaaaaaacattttcatgaataatttggggtttattgaaaggattacctacctgacaggtatttgtctggtattctgaatcttccaaatggtctggtgagatgctgaagctttggaaaggtgaacacggtggctggacacagcttgtgttatggcccaccaaaagtgtattttctctttccccctcattttattacatcagtctgtaactagaggcactagaagtcaggaaatagaatagctaggcttgctcttaaccaacaacaaagatgaccagcaagatgccaaggtaactgatgacagtttacacaaaatttcttacttttctaagagctcacgtttgcttacaactattttcttcatgcccgtctaggtgaagtttgaatgtctaaaaattctaaagcacttttaatacttacaagttagcactgcttcatcatcacattgagaccttttttgttcaattctgtataaaggataagaccagctggcagcaaatgtgaacttttgcagtgacattttcttaaaacttggagaaagctttgcatagttgccatcgtcttgtaaagaggccctgtgaacattgttctgtaggaatttaatttacttgacaacagtagatcccacaaaatgtccttgaagatcacatatccctgaacaagggagatgatagaaggttgaagtagtaattccagtttgcttttcatgtcctccggatttaagttgcaaatgattttttgagttcttttctctcactccttgtcagagccaagtggaaaataatggaattggacattttggcttaatttgtctttagatttttttttttttaaataaaacttgtaaagggcatgtctctttcaggttttgtttttttttttctccagcctttcctccagtatgcctgcatatagcagtttgaatacctaaacgtttttttggtttttctttctttttaaataggagaatttcagatctagagctgctgctagcacatatagtgcctttgttccagctactaatcccctttcccctccctcagatgaattaccaaatggggcccctacatcagcagggtgccttgatgaaggcaggacctaaagtatgtgatcatggggatgccctgctcactggccacagtcaaggcgtgtgttaaaatatgtgctgaacataaaccacctagaaaaatagccctggaagtgtagccttcagctcctctacccacagctgactaaaaacattggcaagtttgtcacctaggctgttgtcacccgaatataaatgagacccatttctggccagaaaacttcagctatcacagtctacattgtgatgagttgcttggctgtttttccaagcaaaagaaggtgcatggtctcatgtatttcctcccaactcttatttatttatttatattttttgagacagcatctcgctctgtcgcccaggctggagtgcagtggtgcgatctcggctcactgcaacctccacttcccaggttcaagcaattctcctcctcagcctcctgagtagctgggattacaggcgtgcgccaccatgcccaactaatttttgtatttttagtagagacagggtttcaccatgttggttaggctggtcttgaactcctgacattgtgatccacccacctcggcctcccaaagtgctgggattacaggcgtgagccaccgcgcccagcccccaactctttacacatctagttgtctgtgttgttgtgcctgtgtcgttgtgccttatggtggagaagggaaggatcctgggcctctgttgctctgtactgggtggacatgggggaaggacttgatggagcgaggtgtcaggatgcaattggaatgtggatggcattcaggatgaggcattgtctttggataggatgtgtttgagtctggtggagagagatggggaaggtgcccactcagcagctgtctcaaagtagctttacttcttggaagtcctcacacagtgatctcaaaatatagcctgatatatgtgtgtgtatatatatatatgtgtgtgtgtgtgtgtgtgtgtgtgtgtgtgtgtatttatttatagccctgattaaaaaattgggatcaacaatattcaggagagtttacataaagatctgattgcctgctactctcataaaatctgaagatttgctctcattgaaaataacagcaagtcccctcagtgtaggtggcataacacacaccagagttctgactcatgtataccggattggcttcaatcatttgttactcgcaaacatcgaaagctattttagtttgccagtcctgggttcaaaactacaaaacacttaagtagaattgggtctctgaagaagagacgttctacagcttcagttgaggggaagacaaacataacacatcatctttaaaaatagctaacatttattaagcacttagtgtgtgccaggccgtgcattaagcattttacatggattatctccctgagtctgcataaacccattttacagatgaagaaaccaaggtgtaaatgagctaaatgcagattatcccgtacttaggttgcattttattcaaagtacgctttgctcaagaccatgcttaattcaaaatgaatccttacaaaggttggctggtatttctacttagcagctggaggggatctagcatttgtcggtagatcagaatactagtttaaagctccttcaaccagatagttttgaaatcacgcttttctcaacaaatcttaaacaatggattttcatttattggaaattttgcaaataaaatgagatctaattagtactttaatttggtgagttaaattttgtataaaatgccactttattataacttgttcaagatcgagtcatactagtgaatctgtctcaaatcatgagcaatgtaaaatacatttctatgaaaatacatgttgcaactgttagcagagaagtggtaacggcagggtgggtgtatccccttctcacctgtgggtctgaaaaatgatcatcattgcctagtggatggtggaggtcactgatgccaagtttttgaaatggtttttacatgcagtcaagctgcggttgatggcattcaagagcattctgtttaggcattggaatggaaatcctggacttttatttttcaactttacctttggacttgatgagataggttttttttttttttttatgaagtcagctcactggtaactcttaacagaaccactgtttccttttccacctgtggcatttggggaccacttttttatactgggttttgactgttacggttctatatatctgtgtatatcttcaaaggatacatatacgtttgttgtctggacatggctgcatacgtgtctagagcacatattctggtctagagccagcctgggccggcctgattcacctctccactcatttcctattgctacagagctaaggagaggcctctgggaatggggatggtgggaggtggggtgggtacactatataatgtcagtggacagagcggtaaatgtgtaaggggacatgtggatttatcagtatatccaagaatagaactataggactatactgtatgtgctgctgtagatgacactactgtgttaaacttgcgtaaacttcaaatattaatctagtcaggaagttttagaaaataaaaagcctgtactaaagtaggcatcctcttgatatgtgtcagtttattgcttggcatgtttgttatatgatcattaaattactctggcccgttcttttaacaataaagcattgaagacttctcttctgttaaacactaaatcccttccccggcttgatgaggtttagatagcaactcagttggactgatctgtttccggagtttgttactgccccgtgcacaaattggcacagaagtgaatggctagttattgaagtcaggcttgcttctcggtgcatccttagcctcatggttttagaccctgtcaaagacgagcaaatagttgggaatgtgcccaagcaaagacccatctcctatggcactcatccagaaaacacactgataaaattggccaaatgtagcctcaactggcccactgatgctcgaaatgatttccttccattgtttccaacttgatgcatgtggtttctggaaccaggagagagggtgaatgttcactctggccagaaaaattatctctttgcctccctcttaagcagtcggatactttgctgacatgtaggggttttgtcctaatagtaagtcctctggaattggctttgtctctgtgtgttttatagatgcggcatttggtagaggatttacttttgtgagtttgtatccatcttttttttttttttcaatattttaatctgagctgagttctgaggcagagaaacactccttaatgacctgaagaactatgttgctttttcaagggttgatgcttagatcaagtcttagatcttcttgggcctttgacagctgcgtaacccaatcccctctttataggaaagagacagcctgggatcacagttagttgcagagtgaactatggcaggcatccagaccactgaccttttccttagagaagagctgtttaagcatataagattatagcattgatgtcatactttttcttttcagacacactcagtggggggagcctgagataatagggaatccagcctgtaattgtttgtggcttaagcgactttcattattggctctgtggtggctcttataatcctaatagctgcttccaggggtgggtaattctttagtcattataggtgactttatttgtctcttcttctcttgctaggcccatcaattctgtttgctaccaatcacccttcctcaagccatgctttgcttagtggtaccatcatttgttaaatcttcattgctgacgtcgcctcacagtttcaccttctgaaagatgttcaagctaacagcctaacttgagctctaaggatgacatcacattgacattttgatgttcaaaggcaggatatggggattgtttgctgcatgaggatatgaagtttgagagagatggtgatttaagctttaaaattgttgtaaagtccagttactattcagccttattattgatctggcatgcaaggtgtgttttgcctagttccgtgttttcatgctactattgagagtgactcggcagccacgttgaagctgattcattgaaccactagcccattagcttggggctctactcaaacggtcattttaccaatgaagcaacgctgccatttatcaggaaatatatggcctggatctttacatgtatgtttgaagataggtcttttaaaatgacagaaatagctattgatctaggtaaaatgtgaacttactctttagagaaagagccattcgctagttcattgatttatttatcacattttagatggacaccttctgtatgtcaggcactgtcctaggtgctaagaatacatcagtgagtagaacaggaaaaaaaatccctgtcctcatcttgtgttgctggttctaatattttccttgcacctactgcatccctataaaaaatatttttcaaacatggcggtatcctgtgaagaaaagaactggctttctatactttgctttcttccccctccccactctgtgttataatttttcccttggaacaattagaggtctgtttactctaatggtaattttcagtaggatttttggtacggttttctactttattcttccacctggttgatacaggtagcacttagacaaagagaacttcagattatcacctgattacataattatcaggaagaagacacatattaagatacatgcatggcttttttcctgaaaggaatctccctgtgttgtctgtgttaacaagttagggtgcggcttcctattgatcttcctctattctttctatcctgagcattttattgagtaagcctgaccttttcctcctttggtgattagttctgtcactttgtgtatgcaaatacctttagccattgttctgaaacagtgtgagtgattcagcagcacttgctaaacagtcataatccctaaactccacacctagtgactctgattttgtagcatgggaaactagaaactgcttttccaaaaaggagtattgaagaaaggcagggcatacaaacaggttatgcaaacagggcatgcagataggttactttaagaaagactgtgtaaaatgttctagaactgtgggaatattgttgaactactttccactgggcagagccatagtatgacctggccattgtgcacagaagagtccaaatttatgtaccatacatgaaattaagaagccagcaactacctgtaaatgtcacgtaacacccaaggagactgtgttacttatctgctcaccagtgggaggagaagattgtctgtctcagctttgttaaccagctttcttgggatttctccataggcaatggtggcttgctatccgggaaatggaacaggttatgttcgccacgtggacaaccccaacggtgatggtcgctgcatcacctgcatctactatctgaacaagaattgggatgccaaggtacttttgaataatgggagtagagtgtggggttagaaactacaggaaaatgattcagataacttagaggagagtttatattgagttcatagttgccgtatctcccactgatgaaacatttctatttccatttcataacctcctgcgacaatggaattagtcctaaagttgttaagaagaaaacaatgaagttaatttggagtggggtaggtagggtgattattaaccctacctctgggaagggtggttgatgaagggaaggtaatttgatattaggattaaggattaatttttttcagtttaattcagagttgttctgactcaatgcagaataggatatacacttttccctcccagcagcagcattgagaaagttccacaaaaatagaactgtaggctataaaaccatccccaagagagatttcccacacagtcctctccctcggggtggtatgtctcattgatggctgcttgccatggcttactatggtttgtgaatgccaaaggctttgtggcttatttttgtattatagaacttatagatagatggagatatgaagcctggttccatgcttacagacattcatctggactctgtatgctttccgaaagttaagaatgatttaggagtctgggaagtcagataacttttcaagcttatttggcttttgaaccttctgcatctcaatttcctgttcattaggcaaatactggctgtcataaagcaataatatttatccagagtcagaaaaacgaaacttgggaaaccattgaatcagtgaaaaggcctatctcttctccctgtttggtaacatgactggaatacatccattaagtctcctttaaaatcttgagaggtgctgatagagacaagagaataaagttatcagactggtaataataaattgcaaggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactctattttacgtccatgggctttatgactgtggggggtgggagtgctttttttggtttaaggtgaataaggagatatctctagctaagtttgatataaaatttggtacgaagtggctgggcgtggtggctcatgcctataatcccagcacttcaggaggccctagtgggcggatcacctgaggtcgggagttcgagaccagcctgaccaacatggggaaaccccgtctctactaaaaatacaaaattaactgggcatggtggtgcatgcctctaatcccagctactcgggaggctgaggcaagagaatcacttgaaccagggaggtggaagtggcagtgaaacgagatcgtgccattgcactccagcctgggcaacaagagtgaaactccatctcaaattggtacaaactatgaggttgaagtaaaaatctggggtaccatgcatttggagtggtggttagcagatggcatgtttctaaatggagctgaaatatggttgttgataaactacatgagaggtaagaaataatcccccttctttgtgtctttcagctacatggtgggatcctgcggatatttccagaggggaaatcattcatagcagatgtggagcccatttttgacagactcctgttcttctggtcagatcgtaggaacccacacgaagtgcagccctcttacgcaaccaggtaatagccggagccatgattcctcttccggagcttggtgtacaaaccctagttccagagaactctttaaacgtgtgtcctgtgcatgtgggggattgaccacaccccatagctgatagcaaacttgtttggagtctacaaaaattaaaggggaaactttgcgttctttagcatatcaaacctaacctcagtttgaaagtactattaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagagaaagagtaatttgttttgactttctctttttgtcttttccttggtttgaaattggcttgggcttgctgtatccatggtccaacagttggatgttttattaatcttttctttatcatgtgcacatgaagattctcagagtaactgaacaccttagtattgtttaggaccaatctagacaatcttgacaaaaaatcttcattctcaattctgcctctcatttacctttgtctgtgtctaaagcaataagccgggcagcattggagggctatggagtgcagcttatactgagactagcattcaggggcaggaggagagaattttggtaggatgatgattaaaccctaacaagcctaattaaattaagatcacatgtgccctcctccggaagtcacacagcttagccccaaacccagttatatattaactgccaaatcggaatgtcttctagatgagcagggaacgaattctaccactgaagtcagcttttgtgttttatggggtatgtaactaaaccctgttgtttgtggcagaagtctttggttattccccaatctcatgatgactggccttacagggaaaacattagcaaatgttgatgagaagtcccttgaaaaaaactcaagtgctatagaaattgttagctacggaagtagctaacaatcattacaaaatgaaactttaaaaaaaaaccaagcatgaaatggctcccattacagtctatccaatgaatgggataaagcaaattagtggggatgcagtagaaagctctggggcattattattattcaattgcaattttgcctcaatgtccaaaactaaagaaagcaagccaagagttttaaacatactgtgatttacataagtcgtttttcaaagcttcactcaaatgtcatctcttctctatgttctcgccaccaacttgggtctcccagtctttagcagaatgactcccttctagtcctttctgtagaggctatgtttacctgttgcattattgcaaaatcacctgtctcccctacttggagcctgagatcgcagaggaagatctgatcacagggtcatttgaattcctaatgcccaagataatttctggcacatacctggaattccttatgcattttattacattgaaatagaattaaaaccagagaagttaattttaaattaaaatcagcgtagacaggccgggcatggtggctcacacctgcaatcccagcactttgggaggccgaggtgggcaggtcaagagatcgagaccatcctggccaacatggtgaaaccccatctctactaaaaatttaaaaattagctgggtgtggtagcgtgcacctgtagtcccagctacttgggaagctgaggcaggagaatcgcttgaacctgggaagtggaggttgcagtgagccgagatcacgcctctgcctggcaacagagcaagactccatctcaaaaaataaataaataaataaataaataaataaataaataaatcagggtagacttctaataatagagaaaactttaaaacttttaatgtgagatttataggacatttgtgtttctagtagtaccattaaatctctttccttatatctgcttatctttcacagatatgctatgactgtctggtactttgatgctgaagaaagggcagaagccaaaaagaaattcaggaatttaactagtatgtgtttgataattttctgtgacttttgatcaagttaatccttgacttttattcaattttatgtagttttaaacatgttctgttcaatctgttacggcttagctttatatataatgacatcttgatgggttttatcctgaaaccttggccttagggctcttagaaaaatcagaaacaatgcaaggggcttcccctgagaatgcccactgaatgtatgatggtttatgatagatgggaaatagttaactttttcctattaatgttaaccagtcaaatgtaacattaaattttgcccatgatttttggcatattgcaaaggaaatataatggaacccagttatgatggcaaaatttattatattgggtgagactgtgactctcagtataacagcagggctcatgtaatataaactgaatataacagcactactcctatcccttccaaccagtattagaaggcagcatttcccaaaatacgttgcattaaaacacaaatcctgccaatttggtaaattcctggtcccaaaaatgtgggaaatgttgcatgctgtatgcctgtcttaaaaagagtcacattgctcactagcatattaaattaaggcgctaagagatcctgcagtaaggaaacatatataatattgcctagcccataacccatttggactgtatacctctcaaataccaaagtggtctccaaattgcacccaggaaatctcagtttgttttctcttccagatggcctacactgcttaactctgatatgtgagtgaggctacacttcatacaacttatgctcagcattagcccaagaggtgccaatgctggatgtaaacccaaagttcctccacagtctgtgaggcatatgggaaagatcccattgcaaagtcaagagagaatcctttggcagagctctattaggaggcttatataagatgggaagtgtttactggaggctttttggtgacatttgtgacataaaactcatcagagctgactccataccctctttattctcctttctgtccccaacccagggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagcattctaa

SEQ ID NO: 151 - DNA, 26688 bp, Homo sapiens
tggtggcggcggttggggctcggcgctcgctcgctcgctgggcgggcgggcggtgcgatgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggtcagcgccccccgcccggcgtctcccggggccaggtccaccctctgctgcgccacctggggcatcctccttccccgttgccagtctcgatccgccccgtcgttcctggccctgggctttgccaccctatgctgacaccccgtcccagtcccccttaccattccccttcgaccaccccacttccgaattggagccgcttcaactggccctgggcttagccactctgtgctgaccactctgccccaggcctccttaccattccccttcgacctactctcttccgcattggagtcgctttaactggccctggctttggcagcctgtgctgacccatgcagtcctccttaccatccctccctcgacttcccctcttccgatgttgagcccctccagccggtcctggactttgtctccttccctgccctgccctctcctgaacctgagccagctcccatagctcagtctggtctatctgcctggccctggccattgtcactttgcgctgccctcctctcgcccccgagtgcccttgctgtgccgccggaactctgccctctaacgctgccgtctctctcctgagtccggaccactttgagctctactggcttctgcgccgcctctggcccactgtttccccttcccaggcaggtcctgctttctctgacctgcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggccactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggccgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctcttcagactgagccccgttcccctgcatccccgttcccctgcatcccccttcccctgcatcccccagaggccccaggccacctacttggcctggaccccacgagaggccaccccagccctgtctaccaggctgccttttgggtggattctcctccaactgtggggtgactgcttggcaaactcactcttcggggtatcccaggaggcctggagcattggggtgggctggggttcagagaggagggattcccttctcaggttacgtggccaagaagcaggggagctgggtttgggtcaggtctgggtgtggggtgaccagcttatgctgtttgcccaggacagcctagttttagcactgaaaccctcagtcctaggaaaacagggatggttggtcactgtctctgggtgactcttgattcccggccagtttctccacctggggctgtgtttctcgtcctgcatccttctccaggcaggtccccaagcatcgcccccctgctgtggctgttcccaagttcttagggtaccccacgtgggtttatcaaccacttggtgaggctggtaccctgcccccattcctgcaccccaattgccttagtggctagggggttgggggctagagtaggaggggctggagccaggattcttagggctgaacagagaagagctgggggcctgggctcctgggtttgagagaggaggggctggggcctggactcctgggtccgagggaggaggggctggggcctggactcctgggtctgagggtggagggactgggggcctggactcctgggtccgagggaggaggggctggggcctggactcgtgggtctgagggaggaggggctgggggcctggacttctgggtcttagggaggcggggctgggcctggacccctgggtctgaatggggagaggctgggggcctggactccttcatctgagggcggaagggctggggcctggcctcctgggttgaatggggaggggttgggcctggactctggagtccctggtgcccaggcctcaggcatctttcacagggatgcctgtactgggcaggtccttgaaagggaaaggcccattgctctccttgcccccctcccctatcgccatgacaactgggtggaaataaacgagccgagttcatcccgttcccagggcacgtgcggccccttcacagcccgagtttccatgacctcatgctcttggccctcgtagctccctcccgcctcctccagatgggcagctttggagaggtgagggacttggggggtaatttatcccgtggatctaggagtttagcttcactccttcctcagctccagttcaggtcccggagcccacccagtgtccacaaggcctggggcaagtccctcctccgaccccctggacttcggcttttgtccccccaagttttggacccctaagggaagaatgagaaacggtggcccgtgtcagcccctggctgcagggccccgtgcagagggggcctcagtgaactggagtgtgacagcctggggcccaggcacacaggtgtgcagctgtctcacccctctgggagtcccgcccaggcccctgagtctgtcccagcacagggtggccttcctccaccctgcatagccctgggcccacggcttcgttcctgcagagtatctgctggggtggtttccgagcttgacccttggaaggacctggctgggtttaaggcaggaggggctgggggccaggactcctggctctgaaggaggaggggctggaacctcttccctagtctgagcactggaagcgccacctgtgggtggtgacgggggttttgccgtgtctaacaggtaccatgtggggttcccgcacccagatgagaagccccctcccttccccgttcacttcctgtttgcagatagccaggagtcctttcgtggtttccactgagcactgaaggcctggccggcctgaccactgggcaaccaggcgtatcttaaacagccagtggccagaggctgttgggtcattttccccactgtcctagcaccgtgtccctggatctgttttcgtggctccctctggagtcccgacttgctgggacaccgtggctggggtaggtgcggctgacggctgtttcccacccccaggcctgcattgatgagaacctggaggtggtgcgcttcttggtggagcagggcgccactgtgaaccaggcagacaacgagggctggacgccactgcacgtggccgcctcctgtggctacctagatatcgccaggtgaggcaagggagggccgggcaggacctggtcggggtgggggcctggaccctcagccctgaccagcccccacccccaggtacctcctgagccacggggccaacatcgccgccgtcaacagtgacggggacctgcccctggacctggccgagtcggacgccatggaggggctgctgaaggcggagatcgcccgccgaggtgggctctggtgtgctgtgtgtggggtgggggacacctcctcacccgtggtctccaggctgagagctttagaggcggcctgggcaccgaggctgaccctgcttcctaggattgtctttctttgtgcctcagtttcctcacctgtgaaatgggggtgtaggggcctgcctccaggattgcttggagcccagcacacgcacaggatgagaactcaaacccctaccaactgggactgtcaatccccctgagtaactgaggggattggaatgccggggcggggtgggtgggtggagggactcacccaggagtgcgttaggtaggattgctggaaccctgccgcaggtctttctgggaggggatgcgtttacttgggggggagtaggggcatgcaggggttgccagggactggtctccctgtcctctgagactcatcgtaccccaggagccttcatatggggtccaggagcccctgaaactgtgtctggccaggttcatttttctagggaaggggtgttgcttctagcaggtgtgtgatggccacacaggatccctgggtccccagcatgtcttctaaagtcctgggcttgcctcccagctctgcctgtgactggtgactccaggcacgtccctgaagcttgcttccctgatttcctaaaacaggaccactggtgccgcttcatggggtggttgtcagggtctggctgggttggagtggaagggtgtgagcatggttcccggcagactccaggggaccgtgtggaaggaaagggagactgacgaggaaatgagataccggcagcctccgagacttctgacgcggctgtcctgacggggccgctggccaggctgaaaggataggattccgcgtgggttcaggggtccacgagagccatgcgggaggactagctagtgggacacgtgacggcggagatctgaggttcgggagcccctctttggttgaaatggggagtgggtcaaatcagccctggacctggattctgtctccttcctcctccaactttttattttgggaaagcttcagatttacagaaaagttgaagcaatagcatgtgactacccatatgactttcactaagattcgccagtgctttttcttttttgtttttgttttttagacagctttttgagatgtaattcacctaccctacaattcacccaaagtgcacacttcagtgctttttagtctattcacggggtcgggcatttatgaccacattggttgtagaacattttcatcatcccccaacgaaaccctgcaaccgcttagccatcacccccaaccatgcacccccccctcccccccaccccacgaagccctctctgccttctgtctgtggatttgctgttttgtacacttcacataaagggaatcatacagtatagaatcatcagcttttaactttttgatagatttgtgttccttctctctgtccctcccttgcgatctcttcccaggtatagacataaacacattttttcctatcctttctcctcctgtttttttccctccatctctcccttcctttcttaccaccccacccctgcctttccattcctgagccttttttttttttttgaaacagagtttcactttttgcccaggctggagtgcaatggcatgatttcggctcactgcaacctccacctcctgggttcaagcgattctcctgcctcagcttctgggtagctgagattacaggcgtgagccagcatgcccagctaattttgcatttttaatagagatggggtttcaccatgttgaccaggctggtctccaactcctgacctcaggcgatctgctggcctcggcctcgcaaagtgttgggattacaggcgtgagcccggccattctgagactgtgttgcaggcattgtacatcttcgcctgatgcacagcaggtatctcctgccacaaggaaaacctcctgcagaaccacagtagggatgcaacacgctaccccctgtgttgaccttgatgctacactctcacccaccgcaccaaccttgatgctacactctcacccaccgcaccaaccttgatgctacactctcacccaccgcaccaaccttgatgctacactctcacccaccgcaccaaccttgatgctacactctcacccaccgcaccaaccttgatgctacactctcacccactgcaccaaccttgatgctacactgttgcctgcgtttctccttgacattctttgtagcctctcccgctctggttcagggcccagctagggatccagatctgggtgatttaggctccctctgtctggatcagtcctccttttcccttggaccccagggaggccgggaatggcctccagggggtctgtgaactttctgacgttgtattttcctgcagaaattgctcataacttgcatcagcttctcagagggggccatgcttcttccctcccgtggggtgaggagaaggctgggagggatacattggtgggggatattggcttgtaggatcagccaggaacgaagaccactggggccactggaaagaccctcagccgtgctgctcggggtgggactctgcggccccaaatcacaaggcgactgcctgtgacaccctgtgacacccggctccacacaggagcctcagaggggctgcagtgcgcaggacctggatcacaggctgcaccccagctctaaggagggcgggtcttttgcaccccctgcaggacacgcccacatgatgcagaattccccgaggtgctggcatccagactggctctggccatagtgtggccctggcagccactcacaggcagggctgggagagaagacagaccggcctcaggcacgaccatccccttcgctttccctggcttacttgctgttttcctctctctgggtctggggttcagtgagagcacgtgatctgctcagccagtcacctcgtggcctggagccaccgctccctccaacaccgcaaagtcctctggcccagtcgactcaggggctgaatcgggcatgactctttgcaagaaccaaaacccgttcctcctggctcaggccggaaaaggccatttgaggcctggcacagtggctcagacctgtaagcccagcactttgggaggccaagatgggaggatctcttgagcccaggagtttgagaccagcctgggaaacctagtgagaacccatctctataaaacaaaacacattagccaggcgtgggaatgcacgtacgctcccagctactcagtaggctgaggtgagaagattgcttgagcctgggaggtggaagatgcagtgaaccacggtcactccagcctgggggcaagaccctgtctcaaccaaataaaccaaaacaaaaaaggcaatttatatacccgtgttcatagcatcgttcacaatagcccagaggtaggagcaacctagtgcccatcatcgaatgaatggaaaatcaacatgtggcccatccatgcggtgggacatgattcagtcttcatcccagcacttagggaggccgaggcgggcggatcacctgaggtcgggagtttgaggccaacctgaccaacatggagaaactctgtctctactaaaaatacaaaattagccaggggtggtggcacatccctgtaacctcagctgctcaggaggctgaggcgggagaatcactcgaacctgggaggtggaggttgtggtgagccaagatcgtgccactgcactctagcctgagcaacaagaggaaactgtgtctcaaaacaaaaaacaaaacaagacaaaacaaaaaacacacaatgtagatgtatcttgaggacattatgctaagtgaaaagtgaaaataagccagtcacagaaggacaattactgtctgattccacgtctgtgaggtacccagaatagtcaaaataatggagacagacagtagaatggctgtagtcagggactgggaggagtggggagaataggaagtagtttagtgggtacacattttttaaaatgatttttatattttttgtggagacggggtttcaccacgttgcccaagctagtctggaactcttgagctcaagtgatccacccaccttggcctcctaaagtgctgggattgcaggtgtgagccattgtccctgacctagggtacacgattttaattttgcaagatgaaaaaattctggagattggttgcacaacaaccaattgtgactacttaatgccactgaattggggttaaaatggtaaattttaggctgggcgcggtggctcaggcctgtaatccagcactttgggaggccgaggtgggcagatcacctgaggtcaggagtttgagaccagcctggccaacatggtgaaaccccgtctctgctgaaaatataaaagttagccgggcatagcgatgtacacctatagtcccagctactcgggaggctgaggcaggagaattgcttgaacccaggagatggaggttgcagtgagccgagatctcaccactgcactccagcctgggcaacagagcaagactcagcatctcaaaaaaaaaaaaaaaagatggtaaattttatactgtgtgtattttaccacatttttttcactctgagatggagtttctttatttttatttttattttttatttttttaatttatactttaagttctatggtacatgtgtacaacatgcaggtttgttacatatgtatacatgtgccatgttggtgtgctgcacccattaactcgtcatttacattaggtatatctcctaatgctgtccctccccccaccccacgacaggccccagtgtgtgatgttccccttcctgtgtccaagtgttctcattgttcatttcccacctatgagtgacaacatgcagtgtttggttttctgtccttgcgatagtttgctgagtgatggtttccagcttcatccatgtccctacaaaggacatgaattcatccttttttatggctgcatagtattccatggtgtatatgtgccacactttcttaatccagtctatcattgatggacatttgggttggttccaagtctttgctattgtgaaaaacagcagcaatggagtttcactcttgttgcccaggctggagtgcagtggcatggtcttgactcactgcaacctctgcctcccgggttcaagcaagtctcctgcctcagccttccaagtaagtgggattacaagcacccgccaccatgcccagctaatttttgtatttttagtagagatggggtttcaccatgttggccaggttggttttgaactcctgacctcagctgatccacccgtctcggccccccaaagtgctgggattacaggcgtgagtcaccgtgcctggtcacattttttttttttaaaggcagtctatggccttatgtagctgaagtccatatgggctctaggcatagcttgatccaggggcacaagtgaagtccagagcatctctctatcactctgctgaactctgttggcttcactcttagacaggttctctccgtgaggcactcagcatgggtcctactgcaggcccatatcacagccaaaacacagcacctcttgccctgtgcgtgatgctcactgggccaccttggtcagatggcagctcctgagcccatcactgttgcaaaggtgacaggaaggcctggtgatgtgcgcaccctggagccaggctatgggcccggtcacattgaaaccatatggggcaaagtgtgggtgaggaaagtcaagatgaggtcacaggggaagggagaatggattttcgtaggcccaagcagcagctgtgctgcagggacacgcagcagcaccatgtcctgtgcagaagggaccctccctggccactttgcacaggggcatggaactggcaggaagaagacatgatgtgtttttgaaacatttgaagccagctcacttggaattccagcatccaagtcagctggaagagggggagttacccttggaggcaggcggaatcgaccattggatagctccaagtgctgacaagggcggacacgggagctgatttctgcctggtgggaaaggtgatgattccagctactttgggaagtggttggtcagcatggattatagccgaaggccccagctttgccttgttctagcagttccactcctgggcagcccgagagaggccttcccaaccatgggcagatgttcatcatagtattgtttgcagtagtaagaggtcggagcccacaccaaagaggatggatcaatcactaaactctaaatgagtgatctaagcaggggtcagcaaactttctctgtaaagggctagacaatgaatgtttcaggtgttgcgggacacaccatgcctggcaccactattccactagtgctgtggagcgggagactgctagggatggtgtgtgaatgaatgggaatgactgttccatcccacgtttattgacaaaaatcgcctttcagaataggcaaatccacagggacagaaagattgctgggtgcaaggggctggcggagagggaggtctgagaagtgactttttttttttttttaagacaggatctcacgctgcctcccaggctggagtgcggtggagtgataatggctcactgcagccttgacctcgtgggcccaagtgatccttccatctcagcctcccaagtagctgagaccataggtgtgcaccaccatgcccagctaattttatttttctagagacaaggtctccctatgttgctcaggctgttctcaaactagtgggctcaagtgatctcccatcttggcctcccaaagtactgggattacaggcatgagccatggtgcctggctgggagtgacttcttcttggatacagtatccatttgggatcatgaaaaagctcaggaagtagatagtggtgatggttgcataatattggaggtatcctaaatgccactgaattgtgcactttaaaacagggaagttggtaaattttatgttgtttattttaccaccaccaccacaacaaaagataaagaaaacacaacaggtggtcaacacccacaagctatagctttctgacccctgggcaagggctctgtctacagatacagacagatctcagcaacatgttgaacacaagaagcaaattgcagaaggatgtgcagcagacatgcagagggcgctgactgtggttgaataaaaagccagtcaccctcccttcccctccctgaattgagacccattcggctataataggattgaacagttggtgactcctttaaagaaatgacacagccaggtgtggtggctcatgccggctttgggaggccaaggcaggaggatcccttgagcctgggaatttgaggcttcagtgagccataattgcaccactgtactccagcctgggtgacagtgtgaggtcctgtctcaaaaaaaaaaaaagggtcagatgcggtggctcctgcctgtaatttcagcactttgggaggccgaggcgggtggatcatgaggtcaggagttcaagaccagcctggccaacatgatgaaaccccatctctattaaaaatacaaaagttagctgggtgtggtggcgtgtgcctgtaatcccagctactcaagaagctgaggcaggagaaccgcttgaacctgggaggcagaagttgcagtgagccaagatcatgccactgcactccagcctgggtgacagagcgagaccatatatatatatatatggcctaaagtttactgagcaaatccagtgctcaattacatctaacttttcctgtcactaccaatataattttttttttttttggagacggagtctcactctatcacccaggctggagtgcagtggtgcaatctcactgcaacttccgcctccaagattcaagagatccttccgcctcagcctcccaagtaactgggattacaggcataagtcaccatgctgagctaattttggtatttttaggagagacacggtttcaacacgttgggcaggctggtctcgaactcttgacctcaggtgatctgcccaccttggtctcccaaagtgttgggattacaggcatgagccgttgtgccaccccccaatataatcttaatccagcatcttcatacattttatcaccattaccacttctgtctatatatgttacatatataggagagatatatatataggttttatatatataggaaatgtgtatatataggtgttatatatataggagatgcatatatatgttatatatatattatatatataaatattttttatatttatatttttgtatgtgtgtgtgtgtgtatatatatatatatatatacttttttttttttttttttagacagagtctcactgtgttgcccaggctggagtgcagtggcgtgatctcagctcactgcaacctccaactcccgggttcaagcgattctcctgcctcagcctcccaagtagctgggactacagccacctgccaccacacctggctaaatttttttttttttttttgtagttttagtagagatggggtttcactgtgttggccaggctggtcttgaagtcctgagctcgtgatccacctgccttggcctctcaaagttgctgggattgcaggcatgagccactgcacccggccatggttttatattaaaaataataaaaatacggtgaatttctggttgaaatggggaaaggcctgtgatctccgttttcccagtgcttagcgctgactcagagaccctgagtgggacacacgactgcatggagtacagttgggaaacaactgggctagtctgggcctcctgagtctcagaggggagcagggggaagagctctgggcaagtcactgggctgaaccctggccagcccagtgtatgaccctgggtatttcaggtcatggggtgtgagtcctacctcgtgcctcttatcctcctaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggtgagttgggccagtctgttccatcttgctgtcttataccttcctgtggatcttgtcctttccctttctttttaaatgtatgtaccgaaggctatgtatttccctctaaatacagccttagctgtacccacaagttttgatgtgcagtcttttttttattgtcattcagtgtaaaatatttcccaatttgtaatcttttattatttatttattttgagacagggtcttgctatgtcacccaggctggagtgcagtggcacagtcgtggctcactgcagcctcaaactccccaggctcaggtgatcctcctacctcagcctcctgaatagtggggactacaggcgcacaccaccatgccccgctaatttttgtagagatggggtttcaccatgtggcccaggcttgtctcgaactcctgggctcaagtgatcctcctacctcagcctcccaaagtgctgggattacaggtgtaagccactgtgcttggcctaatttcaaaatatataggacttctagtcatcattttgttactattttcctggcttaattgcattgtggtcagagaatgggttccatatgattctagcttttgaaatgtatcgttttaccttatataccccagtacatgtaagtcggaaaagaatggtgtcatcaggtacagtgttctctgtaggttattaggtcaaccttgtaatcatgctgttttatttgtagtgcttctttatctttagtgatatttcacccactgcttattctgtcagttactatgagaggtgcatttaaattcttgctgtgattatggactttgtttcttcttatagttctgtcagttacaatttgtatatattttaagactagattatttggtgcatatatagtttatttttgtttgtttttgagacggagtctcgctctgtcacctaggctggagtgcagtggtgtgatcatagctcactgcaacctccacctcctgggttcaaggaattctcctgcctcagcctccccaggagctgtgactatgagagtgtgccaccacacttggctaactcgtatttctagcagagatggggtttctccatgttggccaggttgctcttgaactcctgacctcaggtaatctccctgcctcagtcttccaaaatgctggggttacaggcgtgagccactgcacccaaccaaggtgcatatatagtttaaattgttctagtacacattccctttctgtcatcctcacctcagtcttagattttgttcctatttggctgcctttcccctttctattaaagttgttggttccagttctcatcctcaggctcctcattcttttttcagttccctcttctctcttttgtgatcatatactttattatttagtataaaaatgaagttaacatgaattcctccctgtctctgctcatctctatgttgacagtttttagtcaggttttctcggtgaggtacataagatgcctctaaccgctccaggccgctgtcccttcggcttagcacctgtaacagctccaggccgctgtcccttcggcctagcacccgtaacagctccagaccgctgtcccttctgcttagcacctgctgaagcagagcccctggacctcagtgtctggccaagtcccagctctgttgctgactgggcccatccctgagctgatccttacgacaagggggactggaaactctaaatggttgggcctagtgatgtgcccaggcctggaggccgtgtccttttcctcccacggcttccacccctgagtcctgggggcggcttcatctcctgccactgcacctgcataccagccagcaggaagagagagggggcaaaggagcaaacatccattcctttcaaaagagcagtccgcaagcggcaccacttaacgccagcatcccatttgccagacgctagtcacatgaccgctcctcgctgcaaggaacagttggagatttgtcttcagctgggtggcctgtgtccggccagggggcctgtgtgggtactgttagtagagggagaaatggaatccatattcgtggaagtgaagcactttggacttagaaatattcatgactatagtgtcattgctgctcctttgtaaggggacatgtttacactcagacctactgactgcattttttattttatttttacttttgagatggagtctcgctctgttgccaggctggagtgcagtggcgcggtctcagctcactgcaacctctgtcccctgggttcaagcaattctcctgcctcaacctcctgagtagctgtgattacaggtgtgctccaccatgcccggctaatttttgtgtttgtagtagagacaggttttgccacgttggccaggctggtctcgaactcttgacctcaagtgatctgcccgcctcagcctcccagagtgctggattataggcatgagccactgtgcctagcctgactgcatttttaaaataatgtaaccagcattctcctcatcaaagatctgttgcaggctgggcgtggtggatcacgcctgtaatcccagcactttgggaggtcgaggcaggcggatcatgaggtcaggagttcaagaccagcctggctaacacagtgaaaccccgtcgctattaaaaatacaaaaaattagctgggcatggtggcaggcgcctgtaatcccagctacctggaaggctgaggcaggagaattgcttgaatccaggaggcagaggttgcagtcagtggagatcgtgccactgcactccagcctgggtgacagtgtgagactccgtctcaaaacaaaaccaaaccaaaacaaaacaaaaaaacatttgttgcagagtagaggtatatgtttatttgatgatactcattcgatgcttatttttgagcccctgctgtgtgccaggcagtctgttaggtgccagggaaatgggtaaacaagacagatctgggcctgtgtgcggctcatagcctcgtggggagacagacattttgggctgatcgctcttgctgcggggccgtcccatgcatcacaggatgtggggcagcctccctggcctccacctatgggatgttgggagcatccctggttgtgagaaccaaaaatgtctctggacgtggccaaatgtcccctggggggcagcattgccccagttgagaactgctggcttaagatataaatagggttatgggagaagacaagtgtgatgaggaggggctttggggtcaggagacagggggatgagggggtggtgactgccaaaaaggggctcagcgtgagatgctgcagggcacagaacactgcccggctgagagcagcaagtgcagaggccagcggcgagcggacgcttggggaaatagcgagggcccagcacagctggggcagggtgagctccgggcaaagcgtgggaaaggtgaagggcaaggtgggcgggaccagagagagggacttgtgcttataaggcctctttgtagaatatcccaggctgtccatctgttcccactttgtgaagctctttctcattgacacagaaactcattccagttctccaaaaatagacacgtcctaccgttaagctgagcttggagagtggccttggacttgtaaccctgcctttgccctcagattgaatggtttaaggtggttattgttttctcgcagaacactgtctcgggtgagggtttctcagcctgggcgctggcagcatgttgggtcaggtccctctccttgtggggctgctgctgagcgctctgagcgcagccgggtgtggagcagcctccctggcctccacccagccgatgccgctaacccttgccctaagttatgacaacaaagatgtctgcagacctgccgggtctcccctgggggacagcattgccctggttgggagtcactgctttaagccagcccgggtcctagagcactactgccctgagacagccctttgggggtcccatccttctgacaggcatgggggctggcaagggtcctgcacttgcatcctccggagctgcctccttacaccccgctgctgccaccttggaatcccacagccagggtgaccccctgccagcaccaggagcaggttccagaggccacctgcagggtcagggtttaacatgtaactgctggtccaaggggagggacaaggcctggtgcagaggggcctcttgtggcagcggatgctgggcagtggctctttaccagcctgtccagggacgtttcagtctcgtggcctgggacctcgttaccaaaccgctggccgaaatcagccctcggccaagggccccgccttggcctctgaccctgagcctccctggcccccaggttgctccttcaggctggctacgacccagagctccgggacggggacggctggactcccctgcacgcagcggcacactggggcgtggaggatgcctgccgcctgctggccgagcatggcgggggcatggactcactgacccatgcggtgagggccagtgcccaggctggtgaggggcagggcgtggggagggcccagcacctccttcattgtctgatcctgctcctcccctgacccaggggcagcgtccctgtgacctggccgatgaggaagtactgagcctgttggaggaactggcccggaaacaggaggacgtgagtgtcagggctgaggggcttaccccagactccccatgtcccctcagctcctcagaggagggtgcagagggggaacccccccgacttctgacacccaccaccccagcgacctgctatttccctcttggtgacccagccccagccccagcctcaggagagacccccagccggggcaggacagagatggggctgcagagcttcctgcctgcctggtggtgggggcggcagaaggatttggacagggttgtctgacaccctgatgaggttgcttagcacacctcatcacctcagggtggcccttggcagcagccatgtgcaggattgtcctagactcaggctgggctggtcacccacaaggtgtcccccagccatccccggggcagccttgctgggaaaacttagagtgaaggagtgaagggcgtgagccttggccagactgcctgggttggaatcccggctctgccatggatctgccgtgagtctcagccagccactttcctttccgggcctcagtttccttatctgtcaaatgggaatggtatggtgcgcaactgtatgaggggtcatgcgtgacacgtggattgtgctgtcaggagctcgggggagtacgtgcccctggaaagcactagagccatgccagcgttcagtgagctctgtgaggtgacaggaagctcccaaggccaggcctagggcttctggtgcgtgggcaggggagcggagacagcttcctcttttgaaaggttggcaggagcgaagtggaggctgatggatgtaggagaagatctcacacaggctggggggcaagtgtgggtgccctgaggtgcccagggaggggagcgtaaggcagggcagacccgggagggccacgagtgccaggcgaggagcatggtggcttccatcctgagggtgatacggccatgaggggtttaataggtggggcagggtcagctcagggggcccagatatggggggagaccagcctgggagcatctggggacactttctggaagacgtgagtactacagcactaagagtttgctagaagggcaggaatgaagggccctcccagtacaaaggtgtgaagacggtggtgaactgcgcggggaaggggcgaagacggtggtgaactgcggggaaggggtgaagacggtggtgaactgcgcggggaaggggcgaagacggtggtgaactgcgcggggaaggggtgaagacggtggtgaactgcgtggggaaggggcgaagacggtggtgaactgcgaactgtgcggggtaggggtgaagacggtggtgaactgcgcggggaaggtgtgaagacggtggtgaactgcgcggagaaggggcgaagacggtggtgaactgcggggaaggggtgaagacggtggtgaactgcagggaaggggtgaagacggtgaactgcggggaaggggcgaagacggtggtgaactgcagggaaggggtgaagacggtggtgaactgcgtggggaaggggtgaagacggtggtgaactgcgaactgcgcggggtaggggtgaagacggtggtgaactgcgcggggaaggtgtgaagacggtggtgaactgcgcggagaaggggtgaagacggtggtgaactgcagggaaggggtgaagacggtggtgaactgcgtggggaaggggtgaagacggtggtgaactgcgaactgcgcggggtaggggtgaagacggtggtgaactgcggggaaggggtgaagacggtggtgaactgcgcggagaaggggcgaagacggtggtgaactgcgcggggaaggggcgaagacggtggtgaactgcgcggggaaggggcgaagacagtggtgaactgcagggaaggggcgaagacggtggtgaactgcggggaaggggcgaagacggtggtgaactgcggggaaggggcgaagacggtggtgaactgcgcggggaaggggcgaagacggtggtgaactgcgcggggaaggggtgaagacggtggtgaactgcgcggggaaggggcgaagacggtggtgaactgcggggaaggtgtgaagacggtggtgaactgcgcggggaaggaggaggcgagtgccggctgcaggagccggggcagctgagggcccaccagtgccctgggtatgctgaggggtcggggtgaggtctaagcaggtctcccctgggagctagaaggacccctctggggatgagactggaggcttctcatgggtgggggccgtgaggacaagacggcagtgcctgcacgtggcagctgcgggcgcctgctggacgcagggcacctcctgcccctgaggtgtgtggccatctgtaggaaaaccagtaagcccacgagccctcggtgcccgcctgggcagtgagctcctgcacagctgtttgtggtggtgttgctgtggggcacgtgtgctccacccctcccctgcagcccccttccctccttgcagcttcggaaccaaaaagaagcttcccagagccggggccaggagccccaagcgccctctagcagcaaacacagaaggtatagggagggaggagtccagggctggcggggtggctggaggccccgggcttgtaccccagcaccctctccttccccaacaggagctctgtgtgtcgtctgagcagtcgcgagaagatttccctccaggacttgtccaaggagcgccggcctggtggggctggggggccccccatccaggacgaggatgagggggaagaaggtcccaccggtgaggggcctgaatctggactcctgggtccgagggaggaggggtcgggttctctgaatctagaggcaactggcatcttctgtgacctgcccggtgttcccacatcacagaaccaccccctgcagaacccagaaccctcaatggcgtctcctccccgccgcaccccagccctaagagtcccgtggtgagtggatgccctgagaggtcctgtgaggctgggagggcccggaggtgggattccatacagcctgtgaacctctggcaggggcagatagggggaagactatagttcccagagtcgtcctggacaaccggcttcctttttaggctgtgcctgccccgggggctgatgggaattgtagtttgttgcagtcctttgggggctaacccttgaggtctgagaagagggatcctttctctctaactgagacctcctccttctcccagcagcttgaagaggcccccttctccaggcgctttggcctcctgaagacagggagttctggtgccctgggtccccctgaaaggcggacagcggagggagcccctggggctgggctgcagcgctcggcttcctcctcctggctggaagggacctccactcaggtgagtgagggttgggccgggtccaggcccaggcccctgcccagtcgagggaactgccccttcctccccttctcctctccacacaggccaaggagctccgtcttgccagaattaccccgaccccctccccgaagctgccggagccctctgtcctgtgagtccccagggcctgggcccctcaggggtgggtggcagatgtgggttccaagcctgtccgtgtgatcctgagtgagaccatgtaccccctggggtctggttcctgccgccactccagagcctgtgctgtgttcctcttgggggctctctccctccctcaggtctgtgttgaaacgtcaccttctcccctatcttccccccaccccgaggtgcacactgaccaccctgctgccaccacggcgccgtccgcacacgcacaccctcccgctctcagttctcgcactgctgcttctgtccagagtcctttatccttctgaccggttgcgtagtgtgctggtcttttcatggcttttgtgggttttgtgtatttctgctcagctctgactctgttgtggcccagataatttgtttctttcactcacggctgcatctccagtgccggcacacaatgcacctgggtaatgtttgtggaatgaatgaattgatgcaggtctgaggtcaccaagcctcctccttgcttggagaactcctcgcctccctccaggattccggagcctgaatccccagcgaagccaaacgtccccacagcctccacggcgcccccagcggactcccgggaccgacggaggtgaagaggccagggcaggaagctgccgcccccgcccccagcagggagagacgatgtgaagcaggagtcccggggctttgggtgggctcctgagggagagctggcctcaggtctgctgggagttggagtcccctcccacagaacttgcttcccgcggagggtgtcagccacggaatgggacagggtccccaggttccctgtctgaggttgggacccttccctcaggtcctaccagatgcctgtgcgggatgaggagtcggaatcccagagaaaagctcgctcccgtctcatgcgccagtctcggaggtccacacaggtgtggggtgggctggggtctggactcctgggtctgagggaggaggggctggggcctggactcctgggtctgagggaggaggggctgggggcctggattcctgggtctgagggaggaggggctggggcctggactcctgggtctgagggaggaggggctggaggtctggactcctgggtctgagggaggaggggctggggcctggactcctgggtctgagggaggaggggctggggcctgggctcctgggtctgagggaggaggggctggggcctggactcctgggtctgagggaggaggggctggaggtctggactcctgggtctgagggaggaggggctggggcctggactcctgggtctgagggaggaggggctggggcctgggctcctgggtctgagggaggaggggctggggcctggactcctgggtctgagggaggaggggctggggtctgggctcctgggtctgagggaggaggggctggaggtctggactcctgggtctgagggaggaggggctggggcctggactcctgggtctgagggaggaggggctggggtctgggctcctgggtctgagggaggaggggctggggcctgggctcctgggtctgagggaggaggggctggggtctgggctcctgggtctgagggaggaggggctggggcctgggctcctgggtctgagggaggaggggctggggtctgggctcctgggtctgagggaggaggggctggaggtctggactcctgggtctgagggaggaggggctggggcctgggctcctgggtctgagggaggaggggctggaggtctggactcctgggtctgagggaggaggggctggggcctggactcctgggtctgagggaggaggggctggaggtctggactcctgggtctgagggaggaggggctggggcctggactcctgggtctgagggaggaggggctggaggtctggactcctgggtctgagggaggaggggctggggtctgggctcctgggtctgagggaggaggggctggggcctgggctcctgggtctgagggaggaggggctgggccctgaccccagcgtcccctgactgtcccctttccctgccagggtgtgactcttacagacctgaaggaggcagagaaggctgcagggaaggccccagagtcagagaagccggcgcagagcctggtgagaggggtcagcgagggcgagtggggtggtgcgggatgtcctgcttccctgactcgcctccccctcccgacaggacccttcccgaaggccccgcgtccctggagtggagaactctgacagccctgcccagagaggtgaggtctgctctcggggaggtcattcccagggaatcatccagtttctcccatagtcttcttgctttcctgggggcttgacccggggacccaggcaccgagagggggctctggaggtgcctgggctgattcctgcccctcccccagcagaggcgcccgacgggcagggtccgggaccgcaggcggccagggagcaccgcaaggtcggaaaggagtggagggggcctgcggaggtgaggggctcaggtggggccgagctggtgcagagggtgggccggggggcgggcaaagcccttcccatacccgctaaagtccctcccatacccattgaacccccgtctacctgcccacagggggaggaggcggagccggctgaccgcagccaggagtccaggtaggggcggggtgggagaggtggggtctgcgtgcgggccgggccggcccctgacgcgcgctcctcccctgccccagcaccctggagggcggcccctcggcccgcaggcagcggtggcagcgggacctcaacccagaacctgagccagaatcggaagagccagacggaggctttaggacggtgcgatcccacccctccgtcggggctttgcctgctgggtgcccagcttcctggcttccccgcccccccagcatcgccccatcctccacctgaccctcctctacctgacccccagctgtatgcagagctgcgcagggagaacgagcggcttcgcgaggccctgaccgagaccacgctgcggctggcgcagctcaaggtggagctggagcgggccacgcaggtaagggcgccgaggccagggtcacgggaactggcagggccgcctgggtggggcttagactgctgggaggtagagcctggcctgggggtgccggcggggctgggcttcacttgaggggcggggccgagatctcggaggcggagtctgagcgaggggatggggctgtgggcctgccggtggcggggcctggcccgtgggggaagggcttgtgggctgcctagtgggcgggcgggtgcccagcaggagcctaggacccttcagagcagtgctggcttcttctgctgacccctgtgctttctgtgtcctcaccagaggcaagaacgcttcgctgagaggccagccctcctggaactggagagattcgtgagtaggggcagtggggatgggggccagaggcgtccccagcctcacatccctaagtttggaccaagggagccacattgcccttcccagctggcccctggccttcccctgccctcctcagcctcactcagtttctgcactttccctgttcattccaggagcgcagggccctggaacgcaaggccgcagagctggaggaggagctgaaggtgggggctgtgggggctgtgggcagagggccgagggtgggtgggggtgcaacccgccagggctgcccagctgacccttgccgtcccccaggccctgtctgacctccgcgctgacaaccagcgcctcaaggatgagaatgcagcgttgatccgcgtcatcagcaaactctccaagtgacccggagggactttcccgcacccgtatttatacagctgcttctgccacacgcaccccttcccccgtgtgaacacgagtgacagggctccgggggaagtctcagagaagccatagcccccctgggacctccggactgggaggggagcagagtccccaggagccgagggggccacccgaggccaggatggaggtgggaggccgagccaagcagggggacgttgccagaggggaccagggccagagacgggaccaggaaggaactgaggaccaagaagtgcaaggatcagtagccaggaccagagtggccgcctggaggtccccatctcacgtgtgatgccaccccgtcacccctcccctcctgagcagggatccaagaatgtgccaagagtcccgccagcctcagccaggtgggcctgtatatagggtccatgtgcaatagggagggacgtcttctattttttgctgccccctccccgcccactgtctggggcagggggagaaggtattttcgagataaagcacaggcaccacaaataaaagtcgtgaagttgccactcaa

SEQ ID NO: 152 - DNA, 311 bp, Artificial Sequence
  Description of Artificial Sequence: Synthetic polynucleotide
atggccttggtaacctctataactgtgctgctcagtctcgggatcatgggagatgctaagactactcagcctaatagtatggaaagtaatgaggaggagcctgtccacctgccttgtaatcactctaccataagcgggacagattacatacattggtatcggcagctcccttcacaaggtccagagtatgtgattcatggcctcacatcaaatgtgaacaatcggatggcttctcttgccattgcagaggatcggaaaagctcaacactcatcctgcatagggcgacactcagagatgcggccgtttatta

SEQ ID NO: 153 - DNA, 187 bp, Streptococcus pyogenes
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacg

SEQ ID NO: 154 - DNA, 101 bp, Artificial Sequence
  Description of Artificial Sequence: Synthetic polynucleotide
  Description of Combined DNA/RNA Molecule: Synthetic polynucleotide
gcctgctcgtggtgaccgaagguuuuagagcuagaaauagcaaguuaaaauaaggcuaguccguuaucaacuugaaaaaguggcaccgagucggugcuuuu

SEQ ID NO: 155 - DNA, 101 bp, Artificial Sequence
  Description of Artificial Sequence: Synthetic polynucleotide
  Description of Combined DNA/RNA Molecule: Synthetic polynucleotide
gacggaagcggcagtcctggcguuuuagagcuagaaauagcaaguuaaaauaaggcuaguccguuaucaacuugaaaaaguggcaccgagucggugcuuuu

SEQ ID NO: 156 - DNA, 101 bp, Artificial Sequence
  Description of Artificial Sequence: Synthetic polynucleotide
  Description of Combined DNA/RNA Molecule: Synthetic polynucleotide
gctagatgattccatctgcacguuuuagagcuagaaauagcaaguuaaaauaaggcuaguccguuaucaacuugaaaaaguggcaccgagucggugcuuuu

SEQ ID NO: 157 - DNA, 100 bp, Artificial Sequence
  Description of Artificial Sequence: Synthetic polynucleotide
  Description of Combined DNA/RNA Molecule: Synthetic polynucleotide
gtgcggcaacctacatgatgguuuuagagcuagaaauagcaaguuaaaauaaggcuaguccguuaucaacuugaaaaaguggcaccgagucggugcuuuu

SEQ ID NO: 158 - DNA, 100 bp, Artificial Sequence
  Description of Artificial Sequence: Synthetic polynucleotide
  Description of Combined DNA/RNA Molecule: Synthetic polynucleotide
gggttccattacggccagcgguuuuagagcuagaaauagcaaguuaaaauaaggcuaguccguuaucaacuugaaaaaguggcaccgagucggugcuuuu

SEQ ID NO: 159 - DNA, 100 bp, Artificial Sequence
  Description of Artificial Sequence: Synthetic polynucleotide
  Description of Combined DNA/RNA Molecule: Synthetic polynucleotide
gtcaccaatcctgtccctagguuuuagagcuagaaauagcaaguuaaaauaaggcuaguccguuaucaacuugaaaaaguggcaccgagucggugcuuuu

SEQ ID NO: 160 - protein, 4 aa, Unknown
  Description of Unknown: 'DEAD' box family motif peptide
DEAD

SEQ ID NO: 161 - protein, 6 aa, Artificial Sequence
  Description of Artificial Sequence: Synthetic 6xHis tag
HHHHHH

SEQ ID NO: 162 - protein, 4 aa, Artificial Sequence
  Description of Artificial Sequence: Synthetic peptide
SGSG

SEQ ID NO: 163 - protein, 600 aa, Artificial Sequence
  Description of Artificial Sequence: Synthetic polypeptide
MMKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNFGGGKLIFGQGTELSVKPNIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSSRAKRSGSGATNFSLLKQAGDVEENPGPMRIRLLCCVAFSLLWAGPVIAGITQAPTSQILAAGRRMTLRCTQDMRHNAMYWYRQDLGLGLRLIHYSNTAGTTGKGEVPDGYSVSRANTDDFPLTLASAVPSQTSVYFCASSLSFGTEAFFGQGTRLTVVEDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 164 - DNA, 96 bp, Artificial Sequence
  Description of Artificial Sequence: Synthetic oligonucleotide
caggccctggaacccccccaccttctccccagccctgctcgtggtgaccgaggactgccgcttccgtgtcacacaactgcccaacgggcgtgactt

SEQ ID NO: 165 - DNA, 119 bp, Artificial Sequence
  Description of Artificial Sequence: Synthetic polynucleotide
cggcaggctgacagccaggtgactgaagtctgtgcggcaacctacatgatggggaatgagttgaccttcctagatgattccatctgcacgggcacctccagtggaaatcaagtgaacct

SEQ ID NO: 166 - DNA, 81 bp, Artificial Sequence
  Description of Artificial Sequence: Synthetic oligonucleotide
cggcaggctgacagccaggtgactgaagtctgtgcggcaacctacatgcacgggcacctccagtggaaatcaagtgaacct

SEQ ID NO: 167 - DNA, 7520 bp, Artificial Sequence
  Description of Artificial Sequence: Synthetic polynucleotide
acattaccctgttatccctagatgacattaccctgttatcccagatgacattaccctgttatccctagatgacattaccctgttatccctagatgacatttaccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagataaactcaatgatgatgatgatgatggtcgagactcagcggccgcggtgccagggcgtgcccttgggctccccgggcgcgactagtgaattcgagcaaaataaaaaaacgctagttttagtaactcgcgttgttttcttcacctttaataatagctactccaccacttgttcctaagcggtcagctcctgcttcaatcattttttgagcatcttcaaatgttctaactccaccagctgctttgctagcccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgctaccggtgccaccatggccttggtaacctctataactgtgctgctcagtctcgggatcatgggagatgctaagactactcagcctaatagtatggaaagtaatgaggaggagcctgtccacctgccttgtaatcactctaccataagcgggacagattacatacattggtatcggcagctcccttcacaaggtccagagtatgtgattcatggcctcacatcaaatgtgaacaatcggatggcttctcttgccattgcagaggatcggaaaagctcaacactcatcctgcatagggcgacactcagagatgcggccgtttattactgtatactccggagactgaacgactataagctgtcctttggagcagggaccaccgtaacagtaagagccgacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaagagccaaaagaagtggttctggcgcgacgaattttagtttgcttaagcaagccggagatgtggaggaaaatcctggaccgatggacacctggctcgtctgttgggctatcttttctctcctcaaggccggactcacggagccggaagttacacagacaccatcacaccaagtcacacaaatggggcaggaagtgattcttaggtgcgtaccgatttctaaccacctctacttctactggtataggcagattctgggccagaaggtggagttcctcgtttcattttacaataacgagatcagcgagaaaagtgagatcttcgacgaccaattcagtgtcgaaagacccgatggaagtaacttcacactgaagattcgcagtactaaattggaggattccgcgatgtacttttgtgcctctagcctcggagatcgggggaatgagaaactgttttttggcagtggtactcagctgtccgtactggaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaagttaactgagcggccgcgtttcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcaaactaaagcattgtctttaacaactgacttcattagtttaacatcttcaaatgttgcacctgattttgaaaatcctgttgatgttttaacaaattctaatccagcttcaacagctatttcacaagctttcatgatttcttcttttgttaagatatctctagagtcgacccatgggggcccgccccaactggggtaacctttgagttctctcagttgggggtaatcagcatcatgatgtggtaccacatcatgatgctgattataagaatgcggccgccacactctagtggatctcgagttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgtagatgacatggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgctcgaggggggccaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgat

SEQ ID NO: 168 - DNA, 254 bp, Artificial Sequence
  Description of Artificial Sequence: Synthetic polynucleotide
tctctcagactccccagacaggccctggaacccccccaccttctccccagccctgctcgtggtgaccgaagggggaattcgagcacgctagttttagtaactcgcgttgttttcttcacctttaataatagctactccaccacttgttcctaagcggtcagctcctgcttcaatcattttttgagcatcttcaaatgttctaactccaccagctgctttgctagcctaccgggtaggggaggcgcttttcccaa

SEQ ID NO: 169 - DNA, 7077 bp, Artificial Sequence
  Description of Artificial Sequence: Synthetic polynucleotide
acattaccctgttatccctagatgacattaccctgttatcccagatgacattaccctgttatccctagatgacattaccctgttatccctagatgacatttaccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagataaactcaatgatgatgatgatgatggtcgagactcagcggccgcggtgccagggcgtgcccttgggctccccgggcgcgactagtgaattcacaacgccaccttcacctgcagcttcctgctcgtggtgaccgaaggggggaacccccccaccttctccccagcgaattcgagcaaaataaaaaaacgctagttttagtaactcgcgttgttttcttcacctttaataatagctactccaccacttgttcctaagcggtcagctcctgcttcaatcattttttgagcatcttcaaatgttctaactccaccagctgctttgctagcctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcgaccggtgccaccatggccttggtaacctctataactgtgctgctcagtctcgggatcatgggagatgctaagactactcagcctaatagtatggaaagtaatgaggaggagcctgtccacctgccttgtaatcactctaccataagcgggacagattacatacattggtatcggcagctcccttcacaaggtccagagtatgtgattcatggcctcacatcaaatgtgaacaatcggatggcttctcttgccattgcagaggatcggaaaagctcaacactcatcctgcatagggcgacactcagagatgcggccgtttattactgtatactccggagactgaacgactataagctgtcctttggagcagggaccaccgtaacagtaagagccgacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaagagccaaaagaagtggttctggcgcgacgaattttagtttgcttaagcaagccggagatgtggaggaaaatcctggaccgatggacacctggctcgtctgttgggctatcttttctctcctcaaggccggactcacggagccggaagttacacagacaccatcacaccaagtcacacaaatggggcaggaagtgattcttaggtgcgtaccgatttctaaccacctctacttctactggtataggcagattctgggccagaaggtggagttcctcgtttcattttacaataacgagatcagcgagaaaagtgagatcttcgacgaccaattcagtgtcgaaagacccgatggaagtaacttcacactgaagattcgcagtactaaattggaggattccgcgatgtacttttgtgcctctagcctcggagatcgggggaatgagaaactgttttttggcagtggtactcagctgtccgtactggaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaattaattaatgagcggccgcgtttcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttgacgtcaactaaagcattgtctttaacaactgacttcattagtttaacatcttcaaatgttgcacctgattttgaaaatcctgttgatgttttaacaaattctaatccagcttcaacagctatttcacaagctttcatgatttcttcttttgttaagatatcgggcacctccagtggaaatcaagtgctagatgattccatctgcacgggcatgatggggaatgagttgaccttcgatatctctagagtcgacccatgggggcccgccccaactggggtaacctttgagttctctcagttgggggtaatcagcatcatgatgtggtaccacatcatgatgctgattataagaatgcggccgccacactctagtggatctcgagttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgtagatgacatggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgctcgaggggggccaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgat

SEQ ID NO: 170 - DNA, 6977 bp, Artificial Sequence
  Description of Artificial Sequence: Synthetic polynucleotide
acattaccctgttatccctagatgacattaccctgttatcccagatgacattaccctgttatccctagatgacattaccctgttatccctagatgacatttaccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagataaactcaatgatgatgatgatgatggtcgagactcagcggccgcggtgccagggcgtgcccttgggctccccgggcgcgactagtgaattccctgctcgtggtgaccgaagggggaattcgagcaaaataaaaaaacgctagttttagtaactcgcgttgttttcttcacctttaataatagctactccaccacttgttcctaagcggtcagctcctgcttcaatcattttttgagcatcttcaaatgttctaactccaccagctgctttgctagcctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcgaccggtgccaccatggccttggtaacctctataactgtgctgctcagtctcgggatcatgggagatgctaagactactcagcctaatagtatggaaagtaatgaggaggagcctgtccacctgccttgtaatcactctaccataagcgggacagattacatacattggtatcggcagctcccttcacaaggtccagagtatgtgattcatggcctcacatcaaatgtgaacaatcggatggcttctcttgccattgcagaggatcggaaaagctcaacactcatcctgcatagggcgacactcagagatgcggccgtttattactgtatactccggagactgaacgactataagctgtcctttggagcagggaccaccgtaacagtaagagccgacattcagaaccccgaaccagccgtatatcagttgaaggacccaagatctcaggatagtacactctgtttgtttacggactttgactcacaaatcaacgtcccgaagactatggaaagtggtacgttcatcacagataagacggttctggacatgaaggctatggactcaaagagcaacggggcaattgcttggtccaaccagacaagctttacctgtcaggacatttttaaggagactaatgctacttatccctccagcgacgttccgtgtgatgcgactcttaccgagaagtcttttgagaccgatatgaatctcaacttccagaatctgtcagtgatgggtctgcggatcctgcttctgaaggttgcaggattcaatcttcttatgactctccggctctggtcttcaagagccaaaagaagtggttctggcgcgacgaattttagtttgcttaagcaagccggagatgtggaggaaaatcctggaccgatggacacctggctcgtctgttgggctatcttttctctcctcaaggccggactcacggagccggaagttacacagacaccatcacaccaagtcacacaaatggggcaggaagtgattcttaggtgcgtaccgatttctaaccacctctacttctactggtataggcagattctgggccagaaggtggagttcctcgtttcattttacaataacgagatcagcgagaaaagtgagatcttcgacgaccaattcagtgtcgaaagacccgatggaagtaacttcacactgaagattcgcagtactaaattggaggattccgcgatgtacttttgtgcctctagcctcggagatcgggggaatgagaaactgttttttggcagtggtactcagctgtccgtactggaggatctccggaacgtcaccccaccaaaggtcagtttgtttgagccatcaaaggcggagatcgccaacaaacagaaagctacgctcgtgtgtttggctcggggcttcttcccagaccacgtagaactttcctggtgggtcaatggaaaggaggttcattccggagtgtccactgatccccaagcgtacaaggaatccaactatagctactgtctctcatctcggctccgggtgagtgcgacattctggcataatcctcggaaccactttcgatgccaagtgcagtttcatgggttgagcgaggaagacaagtggcccgagggcagtcctaaaccagtcactcaaaacataagcgccgaggcatggggtagagccgattgtgggattactagcgcttcataccaacaaggggtattgagcgctacaattctttacgaaattctcctcggcaaggcgacgctctacgccgtactggtgtctactctcgtggttatggcaatggtgaaacggaaaaacagctaattaattaatgagcggccgcgtttcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttgacgtcaactaaagcattgtctttaacaactgacttcattagtttaacatcttcaaatgttgcacctgattttgaaaatcctgttgatgttttaacaaattctaatccagcttcaacagctatttcacaagctttcatgatttcttcttttgttaagatatcctagatgattccatctgcacggggatatctctagagtcgacccatgggggcccgccccaactggggtaacctttgagttctctcagttgggggtaatcagcatcatgatgtggtaccacatcatgatgctgattataagaatgcggccgccacactctagtggatctcgagttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgtagatgacatggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgctcgaggggggccaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgat

SEQ ID NO: 171 - DNA, 6898 bp, Artificial Sequence
  Description of Artificial Sequence: Synthetic polynucleotide
acattaccctgttatccctagatgacattaccctgttatcccagatgacattaccctgttatccctagatgacattaccctgttatccctagatgacatttaccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagataaactcaatgatgatgatgatgatggtcgagactcagcggccgcggtgccagggcgtgcccttgggctccccgggcgcgactagtgaattctgctttctctgacctgcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggccactagggacagcgatcgggtacatcgatcgcaggcgcaatcttcgcatttcttttttccagatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaacgcggccgcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctcttcagactgagccccgttcccctgcatccccgttcccctgcatcccccttcccctgcatcccccagaggccccaggccacctacttggcctggaccccacgagaggccaccccagccctgtctaccaggctgccttttgggtggattctcctccaactgtggggtgactgcttgggatatctctagagtcgacccatgggggcccgccccaactggggtaacctttgagttctctcagttgggggtaatcagcatcatgatgtggtaccacatcatgatgctgattataagaatgcggccgccacactctagtggatctcgagttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgtagatgacatggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgctcgaggggggccaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgat

SEQ ID NO: 172 - DNA, 5498 bp, Artificial Sequence
  Description of Artificial Sequence: Synthetic polynucleotide
acattaccctgttatccctagatgacattaccctgttatcccagatgacattaccctgttatccctagatgacattaccctgttatccctagatgacatttaccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagataaactcaatgatgatgatgatgatggtcgagactcagcggccgcggtgccagggcgtgcccttgggctccccgggcgcgactagtgaattccctgctcgtggtgaccgaagggggaattcgagcaaaataaaaaaacgctagttttagtaactcgcgttgttttcttcacctttaataatagctactccaccacttgttcctaagcggtcagctcctgcttcaatcattttttgagcatcttcaaatgttctaactccaccagctgctttgctagcccccactgtggggtggaggggagtcaccaatcctgtccctagtggggaggcctaaggatggggcttttctgctagcatcgatcgcaggcgcaatcttcgcatttcttttttccagatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatgagcggccgcgtttcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttgacgtcaactaaagcattgtctttaacaactgacttcattagtttaacatcttcaaatgttgcacctgattttgaaaatcctgttgatgttttaacaaattctaatccagcttcaacagctatttcacaagctttcatgatttcttcttttgttaagatatcctagatgattccatctgcacggggatatctctagagtcgacccatgggggcccgccccaactggggtaacctttgagttctctcagttgggggtaatcagcatcatgatgtggtaccacatcatgatgctgattataagaatgcggccgccacactctagtggatctcgagttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgtagatgacatggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgctcgaggggggccaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgat

SEQ ID NO: 173 - DNA, 5491 bp, Artificial Sequence
  Description of Artificial Sequence: Synthetic polynucleotide
acattaccctgttatccctagatgacattaccctgttatcccagatgacattaccctgttatccctagatgacattaccctgttatccctagatgacatttaccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagatgacattaccctgttatccctagatacattaccctgttatcccagatgacataccctgttatccctagatgacattaccctgttatcccagataaactcaatgatgatgatgatgatggtcgagactcagcggccgcggtgccagggcgtgcccttgggctccccgggcgcgactagtgaattccctgctcgtggtgaccgaagggggaattcgagcaaaataaaaaaacgctagttttagtaactcgcgttgttttcttcacctttaataatagctactccaccacttgttcctaagcggtcagctcctgcttcaatcattttttgagcatcttcaaatgttctaactccaccagctgctttgctagcgtcaccaatcctgtccctagtggcaaatgttgcacctgattttgaaaatcctgttgatgttttgctagcatcgatcgcaggcgcaatcttcgcatttcttttttccagatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaattaattaatgagcggccgcgtttcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttgacgtcaactaaagcattgtctttaacaactgacttcattagtttaacatcttcaaatgttgcacctgattttgaaaatcctgttgatgttttaacaaattctaatccagcttcaacagctatttcacaagctttcatgatttcttcttttgttaagatatcctagatgattccatctgcacggggatatctctagagtcgacccatgggggcccgccccaactggggtaacctttgagttctctcagttgggggtaatcagcatcatgatgtggtaccacatcatgatgctgattataagaatgcggccgccacactctagtggatctcgagttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgtagatgacatggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgctcgaggggggccaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgat

SEQ ID NO: 174 - DNA, 13064 bp, Artificial Sequence
  Description of Artificial Sequence: Synthetic polynucleotide
gtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcccgccgggtaactcacggggtatccatgtccatttctgcggcatccagccaggatacccgtcctcgctgacgtaatatcccagcgccgcaccgctgtcattaatctgcacaccggcacggcagttccggctgtcgccggtattgttcgggttgctgatgcgcttcgggctgaccatccggaactgtgtccggaaaagccgcgacgaactggtatcccaggtggcctgaacgaacagttcaccgttaaaggcgtgcatggccacaccttcccgaatcatcatggtaaacgtgcgttttcgctcaacgtcaatgcagcagcagtcatcctcggcaaactctttccatgccgcttcaacctcgcgggaaaaggcacgggcttcttcctccccgatgcccagatagcgccagcttgggcgatgactgagccggaaaaaagacccgacgatatgatcctgatgcagctagattaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagataaatggtaccagatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcaattagtatttggtagcattgcctttaaattgtttaacttggtctccctttagtgagggttaattgatatcgaattcagatctgctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcataacttcgtatagcatacattatacgaagttatgagctctctggctaactagagaacccactgcttactggcttatcgaaattaatacgactcactatagggagacccaagctggctagttaagctatcaagcctgcttttttgtacaaacttgtgctcttgggctgcaggtcgagggatctccataagagaagagggacagctatgactgggagtagtcaggagaggaggaaaaatctggctagtaaaacatgtaaggaaaattttagggatgttaaagaaaaaaataacacaaaacaaaatataaaaaaaatctaacctcaagtcaaggcttttctatggaataaggaatggacagcagggggctgtttcatatactgatgacctctttatagccaacctttgttcatggcagccagcatatgggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattatcgaattcctattacacccactcgtgcaggctgcccaggggcttgcccaggctggtcagctgggcgatggcggtctcgtgctgctccacgaagccgccgtcctccacgtaggtcttctccaggcggtgctggatgaagtggtactcggggaagtccttcaccacgcccttgctcttcatcagggtgcgcatgtggcagctgtagaacttgccgctgttcaggcggtacaccaggatcacctggcccaccagcacgccgtcgttcatgtacaccacctcgaagctgggctgcaggccggtgatggtcttcttcatcacggggccgtcgttggggaagttgcggcccttgtactccacgcggtacacgaacatctcctcgatcaggttgatgtcgctgcggatctccaccaggccgccgtcctcgtagcgcagggtgcgctcgtacacgaagccggcggggaagctctggatgaagaagtcgctgatgtcctcggggtacttggtgaaggtgcggttgccgtactggaaggcggggctcaggtgagtccaggagatgtttcagcactgttgcctttagtctcgaggcaacttagacaactgagtattgatctgagcacagcagggtgtgagctgtttgaagatactggggttgggggtgaagaaactgcagaggactaactgggctgagacccagtggcaatgttttagggcctaaggaatgcctctgaaaatctagatggacaactttgactttgagaaaagagaggtggaaatgaggaaaatgacttttctttattagatttcggtagaaagaactttcatctttcccctatttttgttattcgttttaaaacatctatctggaggcaggacaagtatggtcattaaaaagatgcaggcagaaggcatatattggctcagtcaaagtgggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgtgtgtgtgtgtgtgcgcgcacgtgtgtttgtgtgtgtgtgagagcgtgtgtttcttttaacgttttcagcctacagcatacagggttcatggtggcaagaagataacaagatttaaattatggccagtgactagtgctgcaagaagaacaactacctgcatttaatgggaaagcaaaatctcaggctttgagggaagttaacataggcttgattctgggtggaagctgggtgtgtagttatctggaggccaggctggagctctcagctcactatgggttcatctttattgtctcctttcatctcatcaggatgtcgaaggcgaagggcaggggggcgcccttggtcacgcggatctgcaccagctggttgccgaacaggatgttgcccttgccgcagccctccatggtgaacacgtggttgttcaccacgccctccaggttcaccttgaagctcatgatctcctgcaggccggtgttcttcaggatctgcttgctcaccatggtaattcctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagccttgccagaaaaaaagcgtcgcagcaggtcatcaaaaattttaaatggctagagacttatcgaaagcagcgagacaggcgcgaaggtgccaccagattccgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggggcgtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagcctcacgcatgctcttctccacctcagtgatgacgagagcgggcgggtgagggggcgggaacgcagcgatctctgggttctacgttagtgggagtttaacgacggtccctgggattccccaaggcaggggcgagtccttttgtatgaattactctcagctccggtcggggcgggttggggggggtggtgacggggaggccgcctggaagggacgtgcagaatcttccctctaccattgctggcttagctccaaaggttgtattgagattagggtgtaccttcgcctctcaatcagcctcccgtcctcagccttgccatctcgctagtccgggacaaatccctagagcgtcttcctctgcgggtctcagcccagcccggggttggctcctcctccgccccggcttccgcgcccctcccgtgtggcaaggagtaccaggcccggggaccccgaggggcttggggcgaagggtcgggactgggggcctccttaacggctcacggacttgcgagaggttcggctcgatggccgtgaaagcgacgaatccgctcctgtgctggcctcttggctccttccattcaaagccagctgcttttatggaagcccgtaacacgtcatctccccctggtactccagatgtccaggctttcagtttagaatagactcagtcctacagttagctttagatctaattctagttttgttacgccaaaaagttcctgcgagtgtgtgtgtgtgcctcatggtactttttaaattaaaaggtgtacagttatttgattgcaaacataaggaacctaaaatgctttcagattttccacatgatctcatgtagaggctaagatctacagcatcagcaagtttatccacccagtttcctaaccccaacacttgctatgaagtcacagcttctcctatttaaataagtgcctattatatttaaataagtgctgtcgttttctgtcatcctatcgattgtaactgcattttagcataaatctagggcaagattggatgagcttggcctttttggatggctatcaaggcaggccttgggaaatgctcctctgaggaaagaagaacgtttatttttaatgagctaattactagatcattatgtttcttcttccagctgtagaatatcattgcccagcttctcgaacaaacttatttattaacaagtatttgagaacctactatgtggccaacgctaagtgacctgcaggcatgcaagctgagcctattctaccaccactttgtacaagaaagctgggttgatctagagggcccgcggttcgaaggtaagcctatccctaaccctctcctcggtctcgattctacgcgtcaggtgcaggctgcctatcagaaggtggtggctggtgtggccaatgccctggctcacaaataccactgagatctttttccctctgccaaaaattatggggacatcatgaacgcagtgaaaaaaatgctttatttgtgaaatttgtgatgctattgctttatttgtaaccattataagctgcaataaacaagttctcgagaagttcctattctctagaaagtataggaacttctggctgcaggtcgtcgaaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttggctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatccatctagatctcgagcagctgaagcttaccatgaccgagtacaagcccacggtgcgcctcgccacccgcgacgacgtccccagggccgtacgcaccctcgccgccgcgttcgccgactaccccgccacgcgccacaccgtcgatccagaccgccacatcgagcgggtcaccgagctgcaagaactcttcctcacgcgcgtcgggctcgacatcggcaaggtgtgggtcgcggacgacggcgcagcagtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacttggtgcatgacccgcaagcccggtgcctgacgcccgcccacaagacccgcagcgcccgaccgaaaggagcgcacgaccccatgcatcgatgatctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaagttcctattctctagaaagtataggaacttctcgagtctagaagatgggcgggagtcttctgggcaggcttaaaggctaacctggtgtgtgggcgttgtcctgcaggggaattgaacaggtgattaccctgttatccctagtaatcccgggatctaatacgactcactatagggagaccatcattttctggaattttccaagctgtttaaaggcacagtcaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcccccgggctgcaggaattcgataaaagttttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaatctagctgcgtgttctgcagcgtgtcgagcatcttcatctgctccatcacgctgtaaaacacatttgcaccgcgagtctgcccgtcctccacgggttcaaaaacgtgaatgaacgaggcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttag

SEQ ID NO: 175 - DNA, 8340 bp, Artificial Sequence
  Description of Artificial Sequence: Synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagttaagctatcaacaagtttgtacaaaaaagctgaacgagaaacgtaaaatgatataaatatcaatatattaaattagattttgcataaaaaacagactacataatactgtaaaacacaacatatccagtcactatggctgccaccatggactacaaagacgatgacgacaagagcagggctgaccccaagaagaagaggaaggtgactgtcgctctgcacctggcaatacctcttaaatggaaacctaatcacactccagtttggatcgatcaatggccacttcctgagggcaagttggtggcattgactcagttggtagagaaagaactccaacttgggcacatcgaaccgtccctgtcctgttggaacaccccagtattcgtcataaggaaagcctccggaagttaccgcttgcttcatgacctgagggcggtgaatgcaaagcttgtaccttttggcgccgtccagcagggagctccagtcttgagtgccttgccacggggatggccgcttatggttctcgatttgaaggactgctttttcagcattccgcttgcggaacaggatcgagaggctttcgcctttacgctgcccagcgtcaacaaccaggccccggctagacgcttccaatggaaagtcctccctcagggtatgacctgttcacctacaatttgtcaacttattgttggtcaaatcctggaaccgcttagattgaagcatccgtcccttagaatgctgcattatatggacgacctgcttctcgcagcgagttctcacgacgggttggaggctgccggagaagaagttattagcacccttgaacgagcagggttcaccatttcaccggataaggtacagcgggaacccggcgtacagtacttgggctacaagctcggttcaacatacgtggcccccgtaggactggttgccgagccaaggattgcaactctttgggatgtacaaaaactcgttggttcacttcagtggttgaggcccgctctcggcattccgccgagacttatgggccctttctatgagcagcttagaggatctgacccgaacgaagcacgagaatggaacctggacatgaaaatggcctggcgagagatcgtacagctctcaacgacggctgctcttgaacggtgggaccccgcccttcccctcgaaggggctgtggcacgctgtgaacaaggagctataggggtcctcggtcagggactttccacccatccccgcccatgtctttggcttttttcaactcaacccaccaaagcatttacagcgtggctggaggtacttacccttctcattaccaaattgcgagcgtccgcggtccgaactttcgggaaagaagtagatatattgttgctgccagcctgttttagagaagatttgccccttccagaagggattcttcttgccttgagaggtttcgcaggtaagattagaagtagcgacacaccgtccatcttcgacatcgcgcgcccgctccacgtgagcctgaaggttagagtcaccgaccatcccgttccgggtcccacagtttttaccgatgcatctagtagtacccacaaaggagtagtagtctggcgcgagggacctcgatgggaaataaaggagatcgcagatttgggggctagtgttcagcagttggaagcacgcgccgtggcgatggctcttctcctgtggcccacgacaccaactaatgttgtaaccgactcagctttcgtagctaaaatgctcctgaaaatgggccaggaaggggtcccatccactgcagctgcatttatccttgaagacgcactcagccaaaggtcagcaatggctgcggtgctccatgtgcggtcccattccgaagtacctggtttctttacagaggggaatgatgtcgccgactctcaagcaaccttccaggcgtatcctcttagggaagctaaagacctccatacagctcttcatataggtccgagagctctgagcaaggcgtgtaatattagcatgcagcaagctagggaggtcgtccagacatgtccacactgtaactccgcacctgccctcgaggcaggggtaaatccgcgagggttggggccgctccagatctggcaaactgatttcacgttggaaccaaggatggctccgcggagttggctggcagtaaccgtagacacagcgtcttctgcaattgttgtaactcagcatggccgcgtgactagcgtggccgcgcagcatcactgggcaacggctatagcggtcctcggacgacctaaagcaataaagacggacaatggcagttgttttacttcaaaatcaaccagagagtggctcgctaggtggggcatagcacacacgactggaatccccggtaatagccaagggcaggctatggtagagagagcaaatcgactgctcaaagataagatccgggtccttgctgaaggggacggctttatgaagcggataccaactagtaaacagggagaacttcttgcaaaggccatgtacgcgctcaatcattttgaacgaggggaaaatactaaaaccccgatccaaaaacactggcgacctaccgtgttgacggagggacctccagtaaaaatcaggattgagacgggcgagtgggaaaaaggttggaacgtgctggtctgggggcgagggtatgctgcagtaaaaaacagagacactgacaaagtaatatgggttccatctcgcaaggttaaaccggacatcgctcaaaaggatgaagtgacaaaaaaagacgaagcgtcaccactctttgcataatgaacccatagtgactggatatgttgtgttttacagtattatgtagtctgttttttatgcaaaatctaatttaatatattgatatttatatcattttacgtttctcgttcagctttcttgtacaaagtggttgatctagagggcccgcggttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 176 - DNA, 7482 bp, Artificial Sequence
  Description of Artificial Sequence: Synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagttaagctatcaacaagtttgtacaaaaaagctgaacgagaaacgtaaaatgatataaatatcaatatattaaattagattttgcataaaaaacagactacataatactgtaaaacacaacatatccagtcactatggctgccaccatggactacaaagacgatgacgacaagagcagggctgaccccaagaagaagaggaaggtgactgttgcgctccatcttgcgataccgttgaagtggaaaccgaatcacactcctgtgtggatcgaccagtggccactcccagaagggaaactggtagcgttgacacaacttgtcgaaaaggagcttcaacttggccatatagaacctagtttgtcctgttggaacactcctgtgtttgtcatcaggaaggcctccgggagttatcgcctgttgcacgaccttcgagctgttaatgcaaaactcgtaccctttggcgcggtgcaacaaggggctccagttttgagtgcattgcctcgggggtggccgcttatggtcttggatctgaaggattgcttttttagtatacctctggcagagcaggatagagaggcctttgccttcacgcttccttcagtgaacaaccaggctccggccaggcggtttcaatggaaggttttgccccaagggatgacttgctccccgacgatatgtcaactgatcgtgggccagatactggaaccactccgattgaagcacccttctttgcgcatgctccattacatggatgacctcttgttggcggccagctcccatgacggtctggaggcggcgggtgaagaagtgataagcaccctggaacgagcgggattcacaatcagcccggacaaagtgcaaagagagcccggagtccaatatctgggctacaagttgggttccacatacgtcgcccctgtaggcctggtagcggaaccgcgcattgccacgttgtgggatgtgcaaaaactcgttggatctctccaatggttgcgcccggcactgggtatcccacccagactgatgggtccattctatgaacaactgaggggctctgacccgaatgaggcgcgggaatggaatttggacatgaagatggcgtggcgcgaaatagtccaactttcaacaacggcggctcttgaacgctgggatcctgccttgccgcttgaaggcgcagtagccaggtgcgagcagggggcgataggagtgttgggacaaggtctcagcacacacccgaggccgtgcctgtggttgttcagtactcaacctacgaaggcttttacagcatggctggaagtcctcaccttgttgattacaaaactcagagcatctgccgtcaggaccttcggcaaggaagtagatatccttcttctgcccgcctgcttccgcgaagaccttccactgccagagggaatactgcttgcattgaggggttttgccggtaagatccggtccagcgatactccgagcatatttgacatcgctagacctcttcacgtctcactcaaggttcgcgtgactgaccacccagttccgggacccaccgtattcaccgatgccagtagtagcactcataaaggggtagtcgtctggcgggaaggacctcgctgggagataaaggaaatagcagacttgggtgccagcgtgcaacaactggaggcccgggcggtcgcgatggcactccttttgtggccaaccaccccgacgaacgtagttacagattcagctttcgtagccaaaatgttgttgaaaatgggtcaggaaggtgtcccttccactgccgcagcattcatattggaggatgccctgagtcaaagaagtgcaatggccgcagttcttcacgtgcgatcccatagcgaagtacctggcttttttactgagggcaatgatgtggctgactcacaggctacatttcaggcttattaatgaacccatagtgactggatatgttgtgttttacagtattatgtagtctgttttttatgcaaaatctaatttaatatattgatatttatatcattttacgtttctcgttcagctttcttgtacaaagtggttgatctagagggcccgcggttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 177 - DNA, 7086 bp, Artificial Sequence
  Description of Artificial Sequence: Synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagttaagctatcaacaagtttgtacaaaaaagctgaacgagaaacgtaaaatgatataaatatcaatatattaaattagattttgcataaaaaacagactacataatactgtaaaacacaacatatccagtcactatggctgccaccatggactacaaagacgatgacgacaagagcagggctgaccccaagaagaagaggaaggtgccaatctcacccatcgaaacagtccccgtgaaactcaagccgggtatggatgggccgaaggttaagcaatggcccttgactgaggaaaaaataaaggcgctcgtagagatatgcacggaaatggagaaggagggcaagataagcaagattggcccagagaatccctataatacccccgttttcgcgataaagaagaaggactcaaccaaatggcggaaacttgtagattttcgggaacttaataagcgaacccaagacttctgggaggtccaacttggcattccgcatcccgccggtttgaaaaagaagaaatcagttacggtgcttgacgttggcgacgcctattttagcgttcctcttgacgaggactttagaaaatacacagccttcacaataccaagtattaacaacgagacacccggaatccggtatcaatacaacgtgctcccccaaggatggaaagggtctccagcaatttttcagtctagcatgaccaaaatcttggaacctttccgcaagcagaacccggatattgttatttatcagtatatggatgacctttatgtcggttcagatcttgaaattggtcagcaccgaacgaagatagaggaacttcgacagcacttgttgcgctggggtcttacaaccccagacaaaaaacaccagaaggaaccaccttttctttggatgggttatgaacttcacccagataagtggaccgtgcagcccattgtcttgccggaaaaggactcctggacagtaaatgatattcagaagctcgtaggaaaactgaattgggcaagccagatatacccaggtattaaagttaggcaattgtgcaaacttttgcggggcacgaaggcacttactgaggttataccactgactgaagaggcggagcttgaactcgcagagaatagagaaatactcaaggaaccggtacatggcgtatactatgatccaagtaaggatttgattgcggagattcagaaacagggtcagggacaatggacgtaccaaatttaccaagaacctttcaaaaatcttaagacgggaaagtatgcacgaatgcgcggcgcacatacgaatgatgtcaagcagttgactgaagcagtacagaagattacaaccgaatctatcgttatatggggaaagactcccaaatttaagctcccaatacaaaaagaaacttgggagacctggtggaccgaatattggcaggcgacatggataccggagtgggaatttgttaacacaccgccgctggtaaagttgtggtatcagctcgaaaaagagccaattgtgggagcagagacgttctaatgaacccatagtgactggatatgttgtgttttacagtattatgtagtctgttttttatgcaaaatctaatttaatatattgatatttatatcattttacgtttctcgttcagctttcttgtacaaagtggttgatctagagggcccgcggttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 178 - DNA, 7374 bp, Artificial Sequence
  Description of Artificial Sequence: Synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagttaagctatcaacaagtttgtacaaaaaagctgaacgagaaacgtaaaatgatataaatatcaatatattaaattagattttgcataaaaaacagactacataatactgtaaaacacaacatatccagtcactatggctcctatatctccaatcgaaacagtccccgtcaaattgaaaccgggaatggacggtccaaaagtcaaacaatggcctctcaccgaggagaagattaaggcattggtcgaaatctgcactgagatggagaaagaggggaaaattagcaaaatcgggccagagaacccctacaatacacccgtatttgccatcaaaaaaaaagatagcactaagtggcgaaagctcgtggacttccgcgaactcaataaaagaacccaggatttttgggaggtacagcttggcattccgcatccggcaggacttaagaagaaaaaatccgtaaccgtgctggatgtgggcgatgcatactttagcgtaccactggatgaggattttaggaagtatactgcattcacaataccttcaattaacaacgaaacgccagggataaggtaccaatataacgtcctcccccaaggctggaagggctctccagcgatcttccagtcttcaatgactaagatacttgagccgttcaggaagcaaaaccccgacatcgtaatttaccagtacatggatgacttgtacgtcggtagtgatctcgaaattggccagcatcgaacaaaaatcgaggaattgaggcaacaccttctgcggtggggtttgacgacgcccgacaaaaagcatcaaaaagagccgccgtttctgtggatgggttatgagctccatccggacaaatggacagtccagcccatcgtcttgccagaaaaagatagttggactgtaaatgacattcaaaaattggtcgggaaattgaactgggcgtcccagatctatccaggaattaaagtccggcagctttgcaagcttctccggggaacgaaggcacttacagaggtcataccccttacggaagaagcggaattggagcttgcggagaaccgcgagatactcaaagagccggtccacggggtctactacgatccatccaaagatcttattgcagagattcagaaacaagggcagggtcaatggacatatcagatctaccaagagccgttcaagaatttgaagacaggaaagtacgcgaggatgaggggcgcacatactaacgatgttaaacaactcactgaggctgtacaaaagattactacggagtcaatagtaatatggggcaaaacacctaagttcaagctcccgatccaaaaggagacttgggaaacctggtggaccgagtattggcaagctacgtggattcctgagtgggaatttgtgaacacacctcccctcgtgaagctgtggtatcaacttgaaaaggagccaatagtcggcgcggagaccttctatgtggacggcgccgcgaaccgagagacaaagctcggcaaggcgggttatgtaacgaaccgaggtaggcaaaaggtcgtaacgcttactgatacgaccaaccaaaaaaccgaactgcaggctatttatctcgcattgcaagactcaggactggaagtcaatatcgtgacggacagtcaatatgcactggggattattcaggcgcaaccggatcagagtgaaagcgagctggtaaaccaaattattgagcagttgataaaaaaggagaaagtgtatcttgcttgggtaccagcccataaggggatcggaggtaatgaacaggttgataaacttgtaagcgctggaattcggaaagtacttacccatagtgactggatatgttgtgttttacagtattatgtagtctgttttttatgcaaaatctaatttaatatattgatatttatatcattttacgtttctcgttcagctttcttgtacaaagtggttgatctagagggcccgcggttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 179 - DNA, 7722 bp, Artificial Sequence
  Description of Artificial Sequence: Synthetic polynucleotide
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagttaagctatcaacaagtttgtacaaaaaagctgaacgagaaacgtaaaatgatataaatatcaatatattaaattagattttgcataaaaaacagactacataatactgtaaaacacaacatatccagtcactatggctgccaccatggactacaaagacgatgacgacaagagcagggctgaccccaagaagaagaggaaggtgggtagtcacatgacatggctgtctgactttcctcaggcatgggcggaaactggaggtatgggtttggcagtacggcaggctccacttattatccctcttaaagcaacgtcaacgccggtttctatcaagcaatatccaatgagtcaagaagctcgcctgggaattaagcctcacatacaacggttgttggatcaaggtattcttgtgccgtgccaatctccttggaatacaccactccttcctgtcaaaaaacccggaacaaatgactaccgccccgtgcaagaccttcgggaagtcaataagagggtagaagatattcacccgaccgttccaaatccgtataatctgttgtcaggactgccaccgtcccatcagtggtatactgtcctcgacttgaaggatgcgttcttttgcctgcgcctccaccctacgtcacagcccctgttcgcgttcgaatggagagaccctgaaatgggtatatcagggcagttgacttggaccagacttccacaagggttcaaaaatagccctactctttttgatgaagccctccacagggacctcgcagatttcaggatccagcacccggaccttatcttgctgcagtacgtagacgatctcttgctggcggcgacaagcgaactggattgccagcagggcacgcgagctctcctccagacactgggtaacctggggtacagggcgtcagctaagaaggcacaaatatgccaaaaacaagtgaagtacctggggtatctcctgaaagaggggcaacggtggctcacagaagcccgaaaggagacggtgatgggacaaccgacgcctaaaacgccacgacaactgcgagaatttttgggcaccgccgggttttgccgcctttggatccctggctttgcggagatggctgctccattgtatcccttgactaaaacaggtacgttgtttaattggggcccagatcagcaaaaggcttaccaagaaattaaacaagcgcttcttactgctccggcactcggccttccggatttgactaagccctttgagttgtttgtagacgagaagcagggatacgcgaagggtgttttgacgcaaaagctcggcccttggcgacgacccgtagcgtatttgtctaaaaagctcgacccagtagcggccggttggccaccatgtcttcggatggtcgctgccatagcggttcttaccaaggacgcggggaaactgacaatgggacagcctcttgtaataaaggcgccgcatgctgttgaagcactggtgaagcagccaccagatcgatggctgagcaacgcaaggatgacacactatcaggccctgcttctcgatacagatagagtccaattcggccctgttgttgccttgaacccagctacgcttttgcctctcccagaagagggtttgcaacacaattgcttggatatcttggcagaagcccacggcacgcggccggatttgacggaccagccgttgcccgatgccgaccatacctggtatactgacgggtcctcattgctgcaggagggccagcgcaaagctggggcggcagtaactacggagaccgaagtcatttgggcaaaagcactgccagcagggacctctgcccagcgggcggagcttattgcgcttacacaggcattgaagatggcagaaggaaagaagctcaatgtctatacggattcccggtatgcatttgccacggcgcacattcacggcgagatctataggcgaagaggactgcttacttccgagggtaaggagataaagaataaggatgaaatcctcgcccttctcaaagccctttttttgccgaaacgcctgagcataatccattgccctggtcaccaaaaggggcattctgcagaggcgcgaggcaacaggatggcagatcaggctgctaggaaggccgccattacggagacgcctgatacgagtacgttgctttaatgaacccatagtgactggatatgttgtgttttacagtattatgtagtctgttttttatgcaaaatctaatttaatatattgatatttatatcattttacgtttctcgttcagctttcttgtacaaagtggttgatctagagggcccgcggttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 180 - DNA, 21 bp, Artificial Sequence
  Description of Artificial Sequence: Synthetic primer
aacgtgctggttgttgtgctg

SEQ ID NO: 181 - DNA, 22 bp, Artificial Sequence
  Description of Artificial Sequence: Synthetic primer
aaagtggtggtagaataggctc

SEQ ID NO: 182 - protein, 4 aa, Unknown
  Description of Unknown: 'DEAH' box family motif peptide
DEAH
